United States Patent 12,371,699 (NUCLEIC ACIDS ENCODING CRISPR-ASSOCIATED PROTEINS AND USES THEREOF) - sequence listing, part 12

SEQ ID NO: 9171 - RNA, 4323 nt, synthetic construct
  misc_feature 1..4323: note = Cas9 variant
  source 1..4323: mol_type = other RNA
atgaaaacaatattaggcttagacttaggcacaaactccataggctgggcgctagtagaacaagacttcgaaaacaagcaaggcttaatactcggaatgggaagccgaataataccaatggatgcaggtattatcggcaaattcgctgaagggtcctcaatatcccagactgcagaaagaacaggatacagatctataagacgattgcgtgaacgacatctattaagacgagaaagactacacagagttctgaatatcctaaaattcctgccagaacattacgcagcagaaatagacttcgagaaaagatttggacaatttttagctgaaacagaaccaaaactcgcctggaagaaaagcgccgaaggaaaatttgaatttctcttccaaagatcatttgatgaaatggtcgcagattttaaagcaaacggacaagatattaaaataccttacgactggacaatatactatctacgaaagaaagcgttaacacagaaaatctcaccacaagagttagcatggataatattgaattttaaccaaaaacgagggtactaccaactaagaggagaagaggaggaagagaaccctaacaagaaagtagagttttactcactcaaaatcgttgatgtcgttgctgacgaacaaccaaataagaaaggagacacctggtattcgctgcatctagaaaatggatgggtctacagacgttcatcaaaaatcccattatatgattggaaagataaagtccgcgatttcattgtaactactgacataaacgaagatgggtcagaaaaattggacaaagacggtgaggtgaaacggtcattccgagcaccaaaagaagacgactggaccctaatcaaaaagaaaactgaacaagaaatagaacaatttaaccaaacggtaggaagctacatctatgaggctttacttgacaatccaacacagaaaataagaggaaaactggtaagaaccatagaaagaaaattttacaaatcagaactcaagaaaatattagaaaaacaaattgaactacaacccgaattatttacagaagatctctataacgcatgtgctagggaactttatcgtagtaatgtagcacatcaacaacaactttcaagtcgcgatttcgtctacctatttctgaacgacataattttctatcaaagacccctaagaagccagaaaagtctaataagtaattgcagtctggaatttagaacaataaaagacaaagatggaaatggccaaataatatacttaaaggcaataccaaaaagtaatccgtattaccaagagttcagagtctggcagtggctatataatttaaagatattcacaaaagaagacgacaaagacgtaaccaaccaatttataaacaaagtggaagacctagaggctctatttgaatttctgatgaaccaaaaagaggttaaccatacggacattctaacttacttaatagaaccaatagtaaaaagtaaatacccgaatgcaaaaggaaaagcctttaaagacgaactcaagaaagaattaaagaaatatagatggaactatgtatatgatgcagataaagacgagtcaaaaagctaccctatgaacgaaaccagatacgaactaagaaaaagactggacaaagttgaaaatgtaccagcagattttatgacacgcaaaatagaacaacacctctggcacataatatattcagtaacagataaaatagagttcgaaaaggctttaaaatcattcgcaaataaatatgatctacatcaagaatcctttgtagagaatttcaaacgcttcaaacccttcgattcagattacggaacctactcagaaaaagcgattaagaaattgttgcctttaatgagagttggaaaatactggagctgggaaggcatagacaataatacaaagaaaagaatcggaaaaatcataacaggagagtacgacgaaaccatcaaaaatcgggtccgtgaaaaagcaatagacctcacagaagaaaaccactttcaaggacttcagttatggctagcccaatacatcgtatatgaccgtcacagtgaagccgatattgcaggtaaatggaacagtgtagccgatctagaacaatatttatcagagttcaaacaacattcattaagaaatccaatagtggaacaagttataaccgaaacactaagagtagttagagacatatggaaacaatatggaaaaggtgccaaagattattttgacgaaatacatatagaactaggacgtgaaatgaaaaatacggcagaagaaagaaaaagactgtcctccataataagcgaaaacgaaacgacaaatctgagaatacgagcaattctagaagaactcatgtatgacgaaaacatggaaaacgtgagaccatattcacctatgcaacaggaagctctaaaaatatatgaagacggcgtacttagttcttcagttgaaattccagaagacatagagaaaatctccaagaaaagcgaacccacaaaatcagaaatccaaagatacaaactatggcttgaacaaaaatacagatccccatatacaggaaggccaattccattatccaaattgttcacaccagcctaccaaattgaacacataataccacaagccaggttcttcgacgatggattttcaaataaagtaatatgtgaatctgaagtaaacgctctcaaagacaaaatgttaggactagaatttatccaaaattactacggtcaaaaagttaccacgtcattcggagaagtaacaatactcacagaagatgcatacaaggctttcgtgaaagaacactacgacaaaaacagatcgaaacgaaacaaattgttattggaagagataccggagaaaatgatagatagacaaatgaacgatacgcgatacatcagtaaatacatatcaaaagttctatcaaatttagttagaggtgaaaaagatgacgagggcgttaatagcaaaaacataatacccggaaacggtaaaataagtggcactctaaaacaagactggggacttaatgatgtatggaatgacctcatattaccaagattcgaaagaatgaaccagctaaccaatagcacagacttcacagcctggaatgaaaaacatcaaaaattcctcccgaccattccactagaactctccaaaggcttccaaaagaaaagaatagaccacagacaccacgcactcgatgcattaataatagcatgcgcaacccgtgaccatgttaatttacttaacaataaacacgcaaaatcgcgaaacgaaagatatgacctccaacataaattgcgacataccaccccatggcaagataaagagggtaaagtccgcaccaaatttacggagttcaagaaaccatgggaaacttttactcaagacactaagaaagagttagagaaaatagtagtatccttcaaacaaaatctcagagtaattaataaagcaaccaattattatgagaaaattgtcgatggaaagaaagtcatgtttaaacaagaaggagtaaactgggcaatacgtaaaccaatgcacaaagaaacagtatcaggaaaaatagatctacccagagtaaaagtaagcaaaggaaaaattttgacagcaacaagaaaatcactagacacatcctttaacgcaaaaacaatcttaagcataacagacactggaatacagaaaatcctgttgaattatttaaaagccaaaggaaacccggaactagcctttagccccgagggaatagaagaaatgaaccaaaatatcagcttatataatgacggaaaaccacaccaaccaatacttaaagtaagagtctttgaacaaggatcaaaatttccactaggcgaaacaggaaataaaacaaccaaatacgtagaagcggcaaagggcacaaacctcttctttggagtgtacgaaaacaaccaaggtaagcgatcctacaacacaatacctctaaacctggtaatcgaaagacaaaaacaaggattgaacagcgtacccgaaactaatgaaaaaggacatagattgttattcagtcttagccccaatgacttagtctacgtaccaatcgaaggtgaagtctttgacaaaaccaatccagacgtaaacagaatttacaagatagtgtccttttcaggctcacaaatgttttgtgtacgccaggatgtcgcaactagcattgtctataaattagaatttagcagcttaaataagatggaaaggaccatagacggtataatgataaaagagatttgtattaaattaaaagtcgatcgactcgggaatataagtaaagcctga

SEQ ID NO: 9172 - RNA, 4323 nt, synthetic construct
  misc_feature 1..4323: note = Cas9 variant
  source 1..4323: mol_type = other RNA
atgaaaacaatacttggtctcgatctaggtactaattccattggatgggccttagtcgaacaagatttcgagaacaaacaaggtctaatactaggaatgggaagtaggataatcccaatggatgcaggcataataggaaaatttgcagagggaagctcaatatcacaaaccgcagaaagaaccggttatagaagcatcagaagattacgggaacgacacctcctgagaagagaaagactacatagggtattaaatatactgaaatttttacctgaacactatgccgcagaaattgacttcgaaaaacgattcggacaatttctagcagaaacagaaccaaaattagcatggaagaaaaacgcagaaggtaaattcgaatttttgttccaacgctcattcgacgagatggtagcagattttaaagcaaacggtcaagacatcaaaatcccttatgattggacaatttactacttacgaaagaaagcactaactcagaaaatatcaccacaagaactggcgtggataatattaaacttcaatcaaaaacgaggatactatcaattacggggagaagaagaagaagaaaacccaaacaagaaagttgaattttacagcttaaaaatagtagacgtagtagccgatgagcagcctaacaagaaaggtgacacatggtactctttacacttggaaaacggttgggtatatagaagatccagcaaaattccactttacgactggaaagacaaagtaagagactttatagttaccactgacattaatgaagatggatcggaaaaacttgacaaagacggcgaagtcaaaagatcattcagagcaccaaaagaagacgactggacattaataaagaagaaaacagaacaagaaatcgagcagttcaaccaaactgtaggctcttatatctacgaggcgctacttgacaatccaacgcagaaaataagaggaaaattggtcagaacaatagaaagaaaattctacaaaagcgaattaaagaaaatactagaaaaacaaattgaattacaaccagaactatttacagaagacttatataatgcctgtgctcgagaattatatagacgaaatgtagcccaccaacaacaattgtcatcacgagactttgtatacttgtttctaaacgacataatattttaccaacgtccacttagatcacaaaagagcttaataagtaactgtagtctcgagtttagaacaatcaaagataaagacggcaatggccaaataatttatctaaaagcaataccaaaatccaatccttactatcaagagttcagagtctggcaatggctatacaaccttaaaatttttacaaaagaagatgacaaagacgtaacaaatcaatttataaataaagtagaagacctcgaggcattatttgaatttcttatgaaccaaaaggaagttaatcacacagatatattaacatacctaatagaacctatcgtaaaatccaaataccctaatgcgaaaggcaaagcattcaaagacgaactaaagaaagaattaaagaaatacagatggaactatgtatatgatgcagataaagatgaaagtaaatcatatcctatgaacgaaacaaggtacgaattacgaaaaagactcgacaaagtagaaaatgtccccgctgattttatgactcgaaaaatagagcaacacctatggcacatcatatactcagtcactgacaaaatagaatttgaaaaagcattaaaatcatttgctaataaatacgacctccaccaagagagcttcgtagaaaacttcaaacgctttaagccgtttgattcagactatggtacttacagcgaaaaagctatcaagaaattattgccgttaatgcgagtgggaaaatactggtcctgggacatcatagacgataaaaccaaaacaagaattggaaaaataattacaggagaatacgatgaaacaatcaaaaacagagtaagggaaaaagccatagacctaacagaagaaaaccatttccaaggactacaattatggttagcccaatacatagtctatgatcgccactccgaagcagatatagcaggtaagtggaactctgtagctgatctagaacaataccttagtgaatttaaacaacactccctgaggaatcctatcgtagaacaagtaataacagaaactctgagagtagtccgagacatctggaaacaatatggaaagggcgcaaaggattacttcgacgaaatacatatagagctaggtagagaaatgaaaaatacagctgaagaaaggaaacgattaagctccataatatcagaaaatgaaacaactaatttgcgaatacgagcaatactcgaagaattaatgtacgatgagaacatggaaaacgtaagaccatactcaccaatgcaacaagaggcacttaaaatatacgaagatggcgtactgtctagctcagttgaaatacccgaagacatagagaaaatctccaagaaatcagaaccgacaaaaagcgaaatccaaagatacaaactgtggctcgaacagaaatacagatcaccatacacaggacgaccaattcccttaagtaaacttttcacgcctgcgtatcaaatagaacacataataccccaagctagatttttcgatgacggattctcaaataaagttatctgcgaaagtgaagtgaacgcattaaaagacaaaatgttagggttagagttcatacaaaactactatgggcaaaaagtaacgacatcctttggtgaagtaacaatactcaccgaagatgcatataaagcattcgtaaaagaacactacgataaaaacagaagtaaacgtaataaactactcctcgaagaaattcctgagaaaatgatcgacagacagatgaatgacacacgatatatatctaaatatataagtaaagttttgagcaacctcgtacgaggagaaaaagacgacgagggagtaaacagcaaaaatattatcccaggaaatggaaagataacaggaatacttaaacaagactggggactgaacgacgtatggaatgatctcattttacctagattcgaacgaatgaaccaattgaccaattcaacggattttactgcttggaatgaaaaacatcagaaattcctacctagtgtaccactagaactaagcaaaggattccagaagaaaagaatagatcacagacatcatgcactcgacgcattaataatagcttgcgcaacacgagaccacgtaaatctattaaacaacaaacacgcaaaatccaggaatgaacgatatgatctacagcataaattacgccacacaactccctggcaagacaaggaaggtaaagtcagaacaaaattcactgaatttaaaaagccatgggaaacattcacacaagacactaagaaagaactggagaaaatcgtggtaaattttaaacaaaatctaagagtcattaacaaagcaacaaactactacgagaaaatagtagacggtaagaaagtaatgtttaaacaagaaggagtaaactgggccatacgtaaacccatgcacaaagaaacagtcagcggcaaaatagacttacccagggtaaaagtatcaaaaggaaaaatactaaccgcaacaagaaaatctctagatacaagtttcaatgcaaagaccatactctcaataacagacacaggaatacagaaaatcctgctaaactatttaaaagcaaaaggaaatccagaattagcattttcacccgaaggcatagaggagatgaaccaaaacatcagcctatacaatgacggaaaaccacatcaacccatacttaaggttcgagtatttgagcaaggctcaaaattccctcttggtgaaaccggaaacaaaacaacaaaatatgttgaagctgccaaaggaaccaacctgttcttcggagtgtacgaagacaatcaaggaaaaagatcgtatgatactatacccctgaatatagttatagaaagacaaaaacaaggactaaatagcgtacccgaaactaatgaaaagggacaccgattactgttcagcctgtcaccaaatgacctggtctacgtgcctatagaaggagaagtattcgatgaaaccaatccggacgtaaacagaatatacaaagtagtatcgttctcgggaagccaaatgttttgtgttagacaggacgtagcaacctcgatagtctacaaactagaattttcatccttaaataaaatggaacgtacaattgatggaattatgataaaagagatatgtataaaacttaaagtagaccgcttaggaaatatatccaaagcttga

SEQ ID NO: 9173 - RNA, 4332 nt, synthetic construct
  misc_feature 1..4332: note = Cas9 variant
  source 1..4332: mol_type = other RNA
atgatcaagttactgtacttggaaaaactgaaacaatatacaatgaaaaaaatactaggactggatttaggaaccagcagtattggatgggcccttgttaacgaagccgaaaatagcgatgaagtaagttcaatcataaaactcggagttcgcgtcaatccacttaccgtagatgaaatgcaaaatttcgaaaaaggaaagagtataaccacaaatgccgaccgaacgctaaaacgcagcatgagaagaaacctacaacgatacaagctacgcagagatgccctgatagagttattaaaaaaagtcggctttataacagacaaaacaattttatcagaacaaggaaataggacaactttcgaaacgtacagactgagagccaaagctgcagaggaagaaataagtttaaaagaattagctagggtactattaatgatcaacaaaaaaagaggatacaagagctccagaaaagcaaagggagaagaagaaggcgcattgatcgatggaatggagatagcaaaaaaactatatgacgaagatcttacaccaggacaattatgcctacaattgttagagtctggaaaaaaattcttccccgacttctatcgcagcgacctgcaagaagaattcaacaaaatatgggactttcaaaaacaatttaaccttttctcattttgcgacgttgcaaaagaagaagtaaaaggaaaaaataaaagtcagacatgggcaatactggccaaatacttcgtagaaacaaaaaaagtaaatgtatggaacgaacacgaggctcaaacggaaaacagagaagaagtatataaattagttggccttaagcgtacagtcaaaggagaagaattgaagaaagaaaattacagatggcgagtccaggcactcacagaacaattagaccttgaaaaaatagctgtagtactccaagaaataaatggccaaatttctgctagttcagggtacttaggagcaatatctgaccgctcaaaagtactttacttcaaccggcaaactgtaggccaataccaaatggccgaacttaataaaaaccccaatatgtcattaagaaatatggtattttaccgtcaagactatttagacgaatttaacgtaatttgggaaaaacaagctgagtttcacaaagaactaactcccgaacttaaaaaagagatccgagatataatcatattttatcaaaggcgattaaaatcacaaaagggattaatatcattctgcgaatttgaaaaccgagaagtggttgtggaaaaagaaggaaaaaaacaaacaaaaataatcggttgtaaagtcataccaagatcacatcccctatttcaggaatttaaaatatggcaaacgttgaataacatagaagtcttcgtaggcgaaaaaaagggaaaaaggaaaaagagcaacgtatcttcagacctattcggagatactgaggacgcactaataacagaaggtaggaggttcctatatcaagaagaaaaaaaaatacttgccaaagaattatcgatcaaaaaaggactcacaaaagctgaaatactcagactattatttgaaaatccacaagaacttgatatcaacttcaaacagatcgacggaaatcaaactggatttgcattattctcagcgtattcaaatatgatagaaaaatatggatacgaaccacttgacttcaaaaaacccgcagaggacctaatttcacaactaaagacagtttttactgatctaggatggaatacagacctactattcattgaccttgataaagagaataaagaatgggagaaacaaccatactttcgactgtggcatctactatacagcttcgagggcgataacacaccaacaggcaatgggaagttgatagaaaaaatcatgcaactatgcgggatagaaaaagaatacgctattgagttggccaatgtgagtttacaagatgattatggcagtttaagtgcaaaagcgatcaaaaaaatattattatatttgaaagaaggaaatcaatacgatatggcatgcgaatatgcaggctacagacactctaaatcaagccttacaaaagaagaaatagaaaataaagtactaaaagacaaactagaaatattacccaaaaactcattgaggaaccctgtagtagaaaaaatactgaaccagatggtgaacgtaataaacaccgttatggaagtatacggaagaccagacgaaatacgagtagaactagcgcgggaactgaaaaaaagcgcgaaagaacgagaagaactaacaaaagcagttgccaagaatacacgcgaacacgaggaaatcagaaaagttttacaaagtgagttcggaatgataaacgtgtctagaaatgacataattcgatacaaattatacgaagagctaaaagacaacggttacaagacattatacagtaatcaatacattcccagagagaaactattctcgaaagaaatagatatagaacatataatcccacaaagccgactattcgatgattccctttcaaacaagacgctagaatataaaagcataaacatagaaaaaggaaataaaacagcatacgatttcgtaaaagaaaaatacggtgaagagggtctacaacaatatttaaatcgctgtgagaatctgtgcaaagataaaaaagccaaattaagaaaactaaaaatggaactgaacgagataccagatggattcatagaccgggacctacgaaacacacaatatattgccaaaaaagccttatcaatgctaacggaaatctgccgtagggtcgtagcgacaaccggtagtataaccgacaaactaagagaagattggcagttggtggatgtaatgaaagaattaaacctaccgaaatatgaagccttaggacttgtagaagtatatgaagataaagacggccgaaaaataaaacggataaaagattggactaaaaggaacgatcacagacaccacgcaatggatgcactgaccgtcgcatttactaaagatgtattcatacagtatttcaataacaaaaatgcagcttgggaaagtgatagcaaagaacatactaacatagtgggcattaaaacacgctattttgaaagcggaaaagccgtcccaccaatacctctaggacaattcagagtagaagcaaaatgccatttagaaaatcttcttgtatcaattaaagcaaagaataaagttgttacaacaaacgtcaactgtataaaaaagaaaggagggacatacaagaatacgcagcaaacaccgagaggacaattacaccttgaaacgatatatggctcacacaatcaatacgtgacaaaaatagaaaaagtaaatgcctcatttgacgcagtcaaaattgctacagtcagcaaacaagattacagaaatgccctattgaaaagactagaagtctttggcaacgacccaaaaaaagcattcacaggcaaaaactcattggaaaagaatcctatctacttggatagagcacaaacaattcaagtcccagataaagtacagacagttgaattagaaactgcatatacaattagaaaaccagtagatccaacactaaacgtagataaagttgtagataagaaaatcagactcatattagaacaaaggctaaaagaatacgggggagacgcaaaaaaggcattcgttaacctagatgaaaaccctatttggctaaacgaagaaaaaggaatatcaattaaaagggttacaataagaggaatatcaaaagcacaggcactacacgacaagaaagacaaagatggtaacttcatccttgacgaaacgggcaaacgaatacctgtagattttgtaaatacaggaaacaatcaccatgtcgcaatatacagaaaaccagttctcgacaaaaaaggacaagtaatttttgatgatgaaggcaacccaatgtacgaattggatgaagatgttgtacctttcttcgaagcagtaaccagggccaatctcggtataccaatcattgataaagactacaaaaagagcgaaggctggcagttcttgttctccatgaaacagaacgaatactttgtattccctaatgaaaaaaccggatttaacccaaaagaagtagatttattagaccccgacaactacgcaatgatatcaccaaacttattcagagtacaaaaaataggattaaatgattacaccttcagacatcatttggaaacaacgatacaaaatgacctcaagtttataacctggattcgatgtggcaaaagcggcataaaagatatagtaaaagttaggataaatcacataggacaaatagtctcagtaggagaatattga

SEQ ID NO: 9174 - RNA, 4332 nt, synthetic construct
  misc_feature 1..4332: note = Cas9 variant
  source 1..4332: mol_type = other RNA
atgaagaaaatactaggactagaccttggaacagcttccatcggaagtgcatatgtactcgaagcagaaaaatcagctgaccaaactaaaatagtatatttaggaacacgaatcattctaagctctgcagatgcagaaaatttctccaaaggtctaagttgttcacccacaacagatagaacattcaaaagatctatgagacgtagattacaaagatataaacaacggcgaagttcgcttatacaacaattcaagaaaatcggaataataactaatacagaacaaattataagggaaccaatctctgaaacccatgaacttctacgaattagatcgaaagcagtcagcgaacacgtctctctagaagaatttgcaagaatattacttaccataaacaaacgaagaggatacaaatctaacaggaaaacatcaaaatccacagaagaagatggcaaactcgtagacgcaatggctgttactaaagaactcataaaactaaagaaaacacctggacaatatatgttcgaacgattcaaacgtggaaaatatgccgaaatagatttctatcccttcgacctaataaacgaactaaaacaaatttgggaagtacaaggtcaaaaatatccagacgtactaaccgaaggactactatcatcacttcttaaacagaaaacaggaaaagcaaaagaattaatctactccaaaagtgatttaaaccctgccgaagtacccatagactatcaaaaaggaaagaaattaaggaaaacaatcctgaacaaatatttcgcttatgaatcccgatcgctagcagttaccaacataataccagttgaacaagcaataactgccattgtagctatatgtaaacagataaacaacagctcaggatatcttggtgcaatcggagataggagccgagtactctatgcgaacaaccaaacaataggtcaatacctatacgaacgaattaaagccaacccacacgacagaataaggggcgaagtcttctatagacaagactatttggatgagttcgatagaatatgggaatgccaacaaaattattacccagcaatattaacaaacgatcgaaaacaatatatacgtaatagaattatattttatcaaagaccgttaaaatccaagaaatccgaactagcattttgtgagttcgaaagtcgagaagtagaacacaacggaaagaaatatacagaaggactacatgtagcacccaaatcatcaccagtatttcaacactttagattgtggcaacgcctagggcagatagaagtaagtccactcagaaaatgggacaaacaatcaaatgagctatttgaacaacaaaataacgcggaccgtgagggcatcctaaacactgaggccaaacaaaaactttttagctacctcaaccttttagaccacttaacagacaatgaaatactcaacatattggggtattcacctgacaaatggaaaataaatttcagagaaataataggaaatcgcaccaataatttaatgatgaaagcctttttctcaatgaaagaaatgactgacggagaacagatcgattgggagaaaaatctcaccaaaattactaacggccaatctttgatcagccccgaacaaattgtagatcttataagacagtttttcgaacgcgaaggaatcacaacttctcttctgtatttcgacccagcaacggacaattttagggaacaatctcactactccctctggcacctcctatatagttacgaagatgataacagccccacaggaacaacatctctctgcaaaacgctggccaagagatatggaataccacacgaactttgcccattattagcttcattaacattcgagagacaatatggatcactaagcactaaagcaatgcgtaaattactaccattcatgcaagagaaaagatacgatgaagcgtgcgaactggccggttatagacactcagcatggataactaaagaagaaaacgcaaaaaggactctcaaaaacaagctacctctactaaggaaaggaagcctacggaacccagtagtagagaaaatactgaatcaaatgacacacgttatcaatacgcacattgctgaatatggcaatccagacgaaataagaattgaaatggcccgcgacatgcaagctaattcaaaacaacgtaaagcgatgacagcagcaataaccgaagccactaaaaggaatacccaatttattgaagaaatccaaaaagaatttggatttaatccaagtaaaaatgacctaattaaatacaaactctggaaagagttagcaccattaggaaacaagaccttatacagcaacatatatatccccaaagaggaactatttacagcaaaatttgaaattgaacatataatacccagagccttgttctatgatgatagcttcagtaacaaaactcttgaacttaattccgtcaataaactcaaaggaaataaaacagcactggactatttagacacgttgggacaagaaaaagcaaacgattatatattaagagtggaagaactaaagaaaatcggagcaatcactcaagccaaatacaagaaacttttaattagagaaaaagatctaggtgacgactttactaatcgcgatctaacaaatactagatatataatcagacacgctgcagatagagacctaacaaatacaagatatataatacgccacgccgccgacatgttactacaagtaacaccgagtatagtgcacacaaatggttctatcacagcaatattaagaagagattggggcctactagatatattgaaagaattaaacctaccaacgtatgaatcaatagataggaaaataagtgacccagaagaaaaactcacacaatcagtagaccgtaaagatggtcaagcgataaaaatgataaaagactggtcaaaaagagacgatcacagacatcacgccatggatgcattaattactgcgctcacaaccagaaaacatgtacaatatctaaacggaaattccggagcagaagaaacagacaaagcacaaaaactagaacaattaaaagcgcttagaaaacaattaataggttccgacggccacttcatacccccaatgcacgatataagggtacaagcaaaagaagcactatcaagagtcattatatcaacaaaagtaaaaggaaaagtaacaacaccaaatactaacattatctgcagtagagataaaactacaggtagaaaaatatacgtcaggcaaactacgctaacacctcgcggagcattacacctagatacgaaatatgggataaacaggtactatcaggaacgagaagtatcaataggaagcaaactaactcaagaagaaataagacttgtatctagcccacacatacaaagcatattattagaaagattaagagcattcgacaacaaccccaaaagtgcatttacgggtcgcaactcagtcgataagaaaccattagaagacaaaaataagaaattagtatacactgataagaaagtaaaacaaacaatattagcgaacagattcgttaaaagagacagagttaactccaaattagacctagacaacgtaatagatacaggtataaaaagaatactagaaagacgcctaaaacagtatggaggaaaatatgaaactgccttcagtgacctagaaaataaccctatatggctaaatgaggaaaaaggaattgcaataaaaagcgttcggattagaggtaaaaacaacacaataactataagacaaaccaacacatgccgcataaaatatgtagcgaacgataataatcatcaccttgcagtttatgccctaccagatggaagcatcaaagatgatatagttagcttctttgacgccgtagaaagatccagaaaaagactaccaataatagacaaacataaaaatcagtctctaggttggaaatacctatttagcatcaaacaaaatgagtactttttactaccacagcaagtagagaaaatagacatagatacaggagaaatatcaatgcaaacaacgttcagccccaaagatctctctcacgaatacatcatgaatccagataactacgcagaacttgccagtcatatattccgagtacaaagcatcagtaaaacaccacagggaaatcgcgacgttaggatatatttatttaaacaacaatacattagtggatcacaaaaagacagcttacatttaaaaggaataacacaccgacaaatttcgtccgcaaaagatttagctgagctagtaaaaattagagtcaaccatctgggcagaattgtatcagtcggtgaaaaatga

SEQ ID NO: 9175 - RNA, 4341 nt, synthetic construct
  misc_feature 1..4341: note = Cas9 variant
  source 1..4341: mol_type = other RNA
atggtgaaaaacattttaggtctagatcttggaactaactcagttggatgggctttaatcaaacaagactttgaaaacaaacaaggtgacatacttggaatgggctcacgcattatacccatgtcacaagacgtgttaggagatttcggaaaaggtaactctataagccaaacagctgaaagaacgaaatacaggtcagtaaggcgcttaagagagagatttctacttcgtagagaacgcctacatcgcgtgctaaatgtactagatttcctgcccgaacactacgcttcgcaaatagacttcaataaaagatttggaaagttcaaagaagaaacagaaccaaagctagcatatagtaatgatggatttatattcaagaaatccttcgaagaaatgatctcggactttaaaacacaccaacctgaattattagagaataataagaaagttccatatgattggactatatattacctaagaaacaaagctctaagtcacaaaatagaaaaagaggaactagcatggatacttctcaacttcaatcaaaaacgaggttactatcaactcagaggagaagaagaagaagaaaaccccaacaaactcatagaattttacagtttaaaaatcgtagatgtattagctgatgaacctcaaaaaggaaaaagtgacatatggtatagtctcatactcgaaaacggctggatctacagaagaagctctaaaatacctctactggactggaaaggtaaaactcgagactttattgtcactacagatctaaacgatgatggatcggtcaaaaccgataaagaaggcaatgagaaaaggtccttccgagcgccaggcgaaaacgattggacacttgttaagaagaaaacggaacaagaaatagataactcagacaaaactgtaggagcatatatttacgaagccctactacaaaatcccaaacagaaaatcaaaggaaaattagttcgtacaattgaaaggaaattttacaaggctgaactaaaacaaatactcgagaaacaaatggagttccacccagaacttagacaagatgatctttactctgactgcgtaagagaattatacaaaaataatgaagcgcaccaactaacgttgtcaaagaaagactttgtacaccttttcatggaagacataatcttttaccaacgaccattacggtcacagaaaagctcaatttcaaattgcacactcgaatttagaaaatataaagatgaaaatggcaccgaacatattcaataccttaaagcactaccaaaatcgaatccatattatcaagaatttaggatctggcaatggatgtacaacctgaacatatacaagaaagaagacgacactaacgtaacaaaagagttcctaaattctaaagctgacttcgaatctttattcgaatttctcaataacaagaaagaagtagatcaaaaagcattactaaaacatttcaaaataaacgataaaacgcatcgatggaaatacgtcgaagacaagaaatatccctgcaacgaaacgaaaacaatgatatcagaacgtttaaagaaagtcgaaaacatcagtgatgacttcttaactagagaaatggaacagaaaatatggcacataatatatagcgtaaacgacaaagtcaaatatgaaaaagcattaaaatcattcgctgagaaaaataacttagatgaaagctcatttttcgaagccttcaagaaattcccaccctttaaatcagaatatggagcctttagcgaaaaagcaataaagaaactattacccttaatgagactgggaaaatactgggatgatgacgagatcttaaaatatagtgacatttatttcaaaaacatagaatatctactcggagtattaaaacaaaaagacaaaaacatatcagacgacaaccggcaaaactggaacaaatctattaataacaaactaagggaggaactagaaatatttcaaaacgcagaaatcgaatcctttcaagggctcaggttacatatagcacaatacattttgtatggacgacactcagaagcagcaatgttaggaaaatggaacagtgcagacgacctagaagagttcctaaaagagttcaaacaacatagcctgcgaaatcccatagtagaacaagtaataactgaaacgttgagagttgtaaaggatatctgggtaaaatatggcaatggcgcaaaagatttcttcaatgaaattcatatcgaacttggccgggaaatgaaactacccgcagaagacagaaagaaaattacaaatcagatatctgaaaatgaaaatacaaacctaaggataaaagccctactagcagaaatgatggtcgactcgtcagtagaaaatgtgcgacctttttcaccaatgcaacaagaaatcctgaaaatatacgaagatggagtcttaaatagtgacatagaaatagaggatgatatactgaaaatatctaaaactgcacaaccatcaccttccgatctcaaacgatacaaactatggcttgaacaaaaatacaaaagcccatacaccggacaaattataccacttaataaattatttacacccgaatatgaaatagaacacataataccacaaagtagatattttgacgatagcttcagtaataaagtaatatgcgaagccgctgtgaacaaacttaaagataatttcatcggattgggtttcatcaaacaatttggtggaacaatagtagaatgcggaaatggcaaatcagtaacggtactcaaagaagatcaatacgaagactttgttaagaaacactatgccaataaccgatccaagcgaaacaaactattattagaagacattcccgagaaaatgatagaaagacaaatgaacgacacaagatatatatcaaaatacatatcaggagtacttagcaacatagtacgaactgaagacggaaccgacgatggggttaactctaaaaacatagtacctggtaacggcaaaataactaacacgcttaaacaagactggggattaaatgatatatggaacgacctaatactaccaagattcgaaagaatgaaccagttgaccaactcaactgattttaccgcatggaatgaaaatcatcaaaaatttcttccaacagtcccagttgaattttcgaaaggattttccaaaaagagaatagatcaccgacatcatgctctagacgctctcgtcattgcatgcgccacaaaagatcatgtcaatttgctaaataatcaatctgccaagagtgacactaagagacatgacttaaagagaaaactcatgaaatttgaaaaggtagcctataatcatcctcaaacaggcgaaagaatcgaaagagaagtaccaaaacaatttctcaaaccctgggaaacttttacagttgaagctaaaaatggattggaaactattatagtttccttcaaacaaaatttaagagtaataaataaagcaactaaccactatgaaaaatatgtagaaaaagatggcgcaaaagtaaaaggcagagtagaacaagccgggacgaattgggcaattcgaaaacctatgcataaagaaactgtctcaggaaaaatagatctcccacgaattaaggttccaaaaggcaaaatactaactgccacccgcaaaaatctagacacttcattcgacctaaaaacaattggttctataactgacacaggcattcagaaaattctcaaaaattaccttcaatacaaagacaataacccagaactagcattctccccagaaggaatcgaagacatgaacaaaaatattgaaaaatttaacgacggaaaagtacaccaacccatcataaaagtaagaatctttgaactaggaagtaagtttcccttaggccagtcaggaaataagaaagacaaatacgttgaagcagccaaaggaacaaacttattcttcgccgtatacgaagataaaaatggaaaacgatcgtatgaaaccatacctcttaacgaagtaatagaacgacaaaaacaaggcctaaccgtagtagacttaaaaggtgtaaatgatttctatttatccccaaacgatctagtttacgtaccatctgaagatgagcttgagaacgtgagtatgatagactacaataagttaagtaacgaaaaagtctacaaagtagtcagttttactggaaaccaaatattctttgtcagacaagacgtagcgacatccatagtaaataaagctgagtttagctcattaaacaaaatggaaagagcaataggaggaactatgataaaagaagtattcgttaaaatcaaaatcgatcgactaggtaacatctcgaaagtatga

SEQ ID NO: 9176 - RNA, 4347 nt, synthetic construct
  misc_feature 1..4347: note = Cas9 variant
  source 1..4347: mol_type = other RNA
atgaaacatatactcggacttgatctcggcacaaactcaataggctgggcagtagtaaaggaagcacaaaacgataatgaacaatcagaaatagtcgacgtaggagtaagggtaaatccacttaccaccgacgagaaaactaactttgaaaaaggcaaaccaatatcgaccaatgcagacagaaccctcaaaaggagtgcccgaagaaacttacagagatataaactaagacggaaagaacttatagaattattaaaagaacatcaacttataagtgaaaatacaatactcacagaaaacggtaaaggcaccacattccaaactctagaactgcgggccaagtctgcgaaagagaaaatatccttgggtgaattagcaagagtctttttaaccataaataagaaaaggggttataaaagtagtcggaaagcgaaaaacggagatgaaggacagctgatagatggaatggaaatagccaaacgtctatacgaagaaaatttgaccacaggacaactatcactacaactgctcaaggagggaaagaaatcactccccgactactacagatctgatttacagtttgaactagacaaagtctggaacttccagaaacaatcacacagtgacatactcactgatgagttctatgcccaactcaaaggaaaaggacagcgcgcaacttcagccctctttttggccaaataccagatatacactgctgaaaataaaggaagcagagaagataagaaactacaagcataccaatggagggttgatgcactatcaaaagaactaactagagaagaactggcattcgtcataactgaaataaacaataatctcaataacagttcaggatacttaggggcaatatcagacagatcaaaagaactatacttcaataacgagacagtcggggaatacttatggaaacaaatagcagcgaatccacacaattctctaaagaatcaagtattttatcgacaagactacctagacgagttcgaacaaatatggaaaacacaaagtgcattctatccagaaatcctaacagacgaacttaagaaagaactaagagatgtagttatattttaccaaagaaaattgaaaagccaaaaatctcttgtctccttctgcgagttcgaaaacaaagaaatagaaattaaaaatgaagatggaactacaactaagaaagtgataggtcttaaagtagcccccaaaagtagtcctctcttccaagaatttaaaatttggcagaatctaaataatgtactaattcgaaagaaaggaagcaaaacaaagaaagtagcgaaaaatcagcaagcagttctatttgaagaagagaaaactatatcagaacttgatttagaggctaaacaagccttattcaacgaactaaacctaaaaggaaatctaaaagcagactactgtctcgaaatcctcggatactcaccaaaagaatgggaaatgaattattcaattctggagggcaaccgcaccaataaagccttatacgaggcatacctaaaaataactgatctcgaaggatacgacgctaaaaaccatctaaaagtaaaattaaataaagacgaagttgaactcgatgatcttaaggtaccagcctcagaaatcaaagatatggtccaggcaatttttaaagaagcaggaattaatacagatattctacacttcaacgcagagcttgacggaaaagacttcgaaaaccaagcatcttaccagctatggcacttactatattcttatgaaggagacgattctaaatcaggaaacgagctattatacaaactgctggaaacaaagtttgggtttaagaaggaatacgcacaaatactagcaaatgtatccctaagcgacgactacggaaatctgagtacaaaagctatgcgcgaaattattacacatctaaagcagggattccccttcacaggaagaaaagacagaccagatgaaccatcagcatgcgagttcgcaggatataaacactcaaaacatagcttaacaaaagaagaaaacgaaaaacgagttttaaaagacagcttagaagtgctaaagaaaaacagcttaagacagccagttgtagagaaaatattaaatcaaatgataaaccttgtaaatgccctacttaaaaagtatagaacagaaaatcccaattttaaattcgacgaaattagaatagagttggcgcgcgaacttaaaaagaaagctgaagaacgagcaaatatgacagctaacataaacaaagcaaaaacagaacacgaaaagataataaaaatcttgaaaaacgaatttggcttacccaaccctacaagaaacgacatcataagatatagactctatgaagaattgaaagataatggatataaagacctatacaaaggagactatataccaagagaaaaacttttctcaaaggaaatcgatatcgaacatataatcccaaaagcacgagtgtttgatgatagcttcagcaataaaacgatcacatatcgaaaaactaacctagaaaaaggagaaagaacagcctatgattacatcgaatccctcggggaaaaacaactggaagagtttctaagtagaatagaaaacctatatgaaataggaaaaccatcgcgcttacacaatagaagaaaccctctaaagaaagttgaagagaaagggataagcgactctaaatataagaaattactcaagaaagagagtgaaataggagatggatttgtagaaagggacctaagagaaacacagtacattgcaaagaaagctaaagaaatactactgcaaatcacaagatcagttttaagcacctcaggtggcataactgatcgattacgagaagactgggatctaataaatgtaatgaaagaattaaacctacccaaatacagagcactaggcctcacaaaaatggaagatagaaaatatggccaacaagtagaagtaataacagattggacaaaaagaaacgaccttcgccatcacgcaatggatgcactcaccgttgcattcaccaaacacaatcatatacaatatctaaattacctaaacgcacgtaaaaatgaaaagcataaagaacacaacaacatcatggcgattcaacaactagagactattaaagtaacagacgagaatgggaacgaaaaacgaatattcaaagcaccgatgcctaattttagacaagtggcaaaagcctttctagaaaatgtcttaataagccataaagccaaaaacaaagtcgtaacgaaaaacaaaaataaaatatcaggcaacaacaaagtacaagaagtactaacaccaagaggacaactacacaaagaaacaatatatggaaaatatcaatattatgttcaaaaagaggagaaaataggaggcaaatttgatttagaaaccattgaaaaagtcgcaaacccgctatatcaatcattattaaagaaaagactagaagaaaacggaggagatcccaaaaaggcattcacaggtaaaaacagtttagccaaaaacccaatatatctagatgaagcacaaacagaacaattaccagaaaaagtgaagctagtatggctagaaaattctttttctatcagaaaagatataacacccgaaaattttaaagacgaaaaactgatcgataagatactagacgagggagtaaaacgtatcctaaaagaacgccttcaaagttttggaaacgatgcaaagaaagcgttttcagatctagaaaagaacccaatatggttgaacaaagagaagggaattgcgatcaagcgggtaacaataagcggagttgcaaacgctgaaccactacataccaagaaagatcatttaggaaaagaaatacttgacaaagagggaaaacctatacctgtagactttatctcaacaggctctaaccaccacgtagccgtttaccgtgatgagaaaggtaacttacaagaaaaagtagtaagcgtattcgaagcagtcgtaagagctaaccagggtctaccaataattgacaagacgtacaatcaataccttggatgggaatttcttttctcgatgaaacaaaatgaaatgttcgtgttcccaaatgaatcaactggatttaaccccaacgacatagacttgctagacccgaaaaataaaaagataatcagcccaaatctattcagagtacaaaaattagcaacaggagattactggttcagacatcacttagaaacaactgtagaaacaaaatctgctacgaaagatatgacatacaaacgtctttcgttaaatcacataaagaacataataaaagttagaataaatcatttaggtgacatagtatccgtaggtgaatattga

SEQ ID NO: 9177 - RNA, 4353 nt, synthetic construct
  misc_feature 1..4353: note = Cas9 variant
  source 1..4353: mol_type = other RNA
atgaaacatatacttggactcgatttaggaagcaacagtattggatgggcattcgtccaacaagatttcgagaataaacaaggcaaaataattgcaacaggaagtagaattattcctatggatcaaggtatactcggagattttgaaagaggtaacactgtaagtcagactgccgaaagaaccacatatagaaacacaagacgactaagggaaaggcatttattaagaagagaaagactacacagagttctacatatcctcgggttcctaccgccacattacgattcacaaatcgacttcaccaaacgatacggaaaatttatagacaacgcagaaccaaaaatagcgtacaataacggtaactttatattcatgaattcatttaacgaaatgattgaagacttcaaaaaatatcaacctcaattattctacaaaaagtcaaacggagaagagtcaaaaattccatacgattggacaatttattaccttcgaaaaaaggctttaagccagaaaataactcaacaagaattagcatggcttatattacactttaatcaaaagagaggttactatcaactcagaggagaagaagaaacagaaaaccccaacaaagaggtagcttttcactccttagaagtcgtggatgtagaagctgaagcacccaataagaaaggcgagatctggtatacgataagactagagaacggatggatataccgacgaacatctaagatacccttagacgactggaaaggaaaaacacgcgacttcattgtcacaacagacctaaatgacgacggcacaatcaaactcgacaaagaaggcaaagaaaaaagaagttttcgcgctccagatgaaaatgattggaatctcttaaaaaaaaaaacagaacatgacattgatttttccggcaaaacagtaggcgcttatatatacgaccatctattacaaaatcccaaccaaaaaatcaaaggtaaattagttcgaactatagagagaaaatattacaaggacgaattgaaagcaatacttgctaaacaaatagctctacaacccgaactattcacggaaacactattagccgattgtataagagaactatatagaaaaaacgaaacacaacagcagaacttactaagcaaggatttcctccatttgtttgttgaagatatcatcttctatcaaaggcccttaagatccaaaaaatcaacaattgcaaactgtacactagaaaagagatcctatatagataaagaaacaaatgaaagaaaagatacacccataaaagtctgtgctaaatcaaacccgtattatcaagaattccgtgtgcttcagtggcttcaaaacttgagaatctacgaaattgaaacggaccgcgaagtaaccgctgaattcatcgaaacagcacaagataacgaagcattatttaatttcttaatgtcacaaaaagaaattgataatgaatcattattaaaatactttctattcgcaaaaaacccacaaataaaagacaaggtagcaaaatcagaactcaagaagtggctaaccacgtatcgttggaactatgtctacgacgccgccgataacagtagtaaaaaatacccgatgaacgaaactggctatgaactacaacaatacctacagaaagtagaaggactacccgctaattttttaactttcgacataacatatagattatggcatctattatattcagtcaaagataaagtagaatttgaaaaagcactaaagaaatttgcccaggaatatcaactagacgaagctagctttgtcgactcttttaagaatttcaaaccctacccaaatgagtatggttcattcagcgaaaaggcaatcaaaaaactactccctcttatgcgtttcggtaaccattgggattttaatagaatcgatgtttcaacacaaaagagaattgacgacctaatcaacggagtagccaacgacgaaataagaacaattatccgcgaaaaggccgaaaagtaccagctgaacagtgaaacatgttttcaaggactaccattgtggcttgcacaatacgtcgtatataaccgacacgcagaggccgcagatatagagaaatggacatcagtcaacgatctagaagcatatttagaagacttcaaacaacactcattgcgaaatccgatagtagaacaagtaattaccgaaacactacgtgtagtacgagacatatggcaaagatatggaggtggacaagctaatttctttgacgaaatacacattgaattaggccgcgaattaaaaaaaaccgcagaagaaagaaaacaattatcaaacaggaaccaagaaaacgaaaatacaaacctgagaataaaaaagctactggcagaacttaaagaagacgctagtatccaaaatgtaaggccttattcacccgtccaacaagaattacttaaaatatatgaagaaggcgtattttctgctaccgatgaagtcgaggaagatatacaaaaaatacgaaaaaaggccgaaccaacaaccccagaaattcaacgttacaaactatggctagaacaaaaatacaagtctccatacactggagaagtgataagccttaccaaactatttacagaagagtatgaaattgaacacattatacctcaaagtagatattacgacgattcattatcaaacaaagtaatatgtgagtcagcggtaaacaaattgaaaacgaatcaactaggccttgaatttatacagaatcaccacggggaaaaagtacgaatcacagcaaacaaagaagtaactatatttactgaagaacaatataaagagttcgtaaaaaaacattacgcaaacaatagcgcgaaacaacaaaaacttctactaaacgaaataccagaaaaaatggtagcaagacaactaaacgatacaagatacatctcaaaatacatatcggaaatcctgtccaaaattgtacgctcggatgagaaagatgagggcgtaaacagtaaaaacataataccatgcacaggaaagataacaaccgcattaaaacaagattggggtttgaacgatgtctggaatgaactcatattaccacgtttcgaaagaatgaatcaactaactcaaacccaactattcaccagctacaatgaccgattccaaaaaaacttacccaccgtaccaatagaatattcgcaaggctttcaaaaaaaaagaatagaccataggcatcacgccatggatgctctagttatagcttgcgccactcgagagcacataaattatatgaataatcaacacgcactagacaaaagtaaagacaaaaaagaaaaacaacaatcacgcatagatctgcgaacaatactgtgcgaaaaaaaaaacaataactggcaattcaaaaaaccctggagcacatttacccaggaagcacaagaagctttagaacatatcgttgtatcatttaaacaaaacctgagggtcataaacaaagccacaaactactacgaaaaatgggaagaaaaaaatggagttttagtaaaaaaaaaagttaaacaagagggaacaaattgggcaatacgaaaaccactgcataaagaaaccgtttcgggaaaaatagttttagaccgtaaaatcggtaaagacaaaattctcacagcaaccagaaaatcagttgatataactttcactgaaaagataatatcaagtataacagacacaggaatccagaaaatattattaaattacctaaagtacaagggaagtcccgaagttgcattctctgcagaaggacttgaagaactaaacaaaaacatcgcacaatataacgatggcaaaaaacaccaacctatatataaagtaaggattttcgaagaggggtcaaaattcccacttggagaaaccggagcaaaagcaactaaatacgtggaagctgctaaaggtacaaacctatttttcggcgtctaccaaggaaaaggtaaaagaacttatgccaccattcccctaaacgaagtaatcgaacgtcaaaagcaaggattaccatccgttccagagagaaatgaaaaaggagaaccattactattcagtctttcgccaaacgatctagtatacgtacccatggagggagaaatagcagagactatagactttaacaacctctctaaagaacaaaaagaacggatatacaaaaccgtttcattcaccggcaaccaatgctttttcgtccaagaagccgtcgcaacccccatagttaacaaaatagaatactcaccactcaataaaatggagcgagatatcttaggcacaatgataaaagaagtatgtataaaactaaaggtagatagattaggaaatataacaaaagcatga

SEQ ID NO: 9178 - RNA, 4353 nt, synthetic construct
  misc_feature 1..4353: note = Cas9 variant
  source 1..4353: mol_type = other RNA
atgaaaaggatacttggacttgatctgggcagcaacagcataggatgggcttttgtagaacaagacttcgaaaacaaacaaggtaaaatcatcgccacagggagcagaataataccgatggatcaaggtatcctgggagacttcgaaaaaggcaacacagtaagtcaaacagccgaaagaaccacgtatagaagcatgagaagacttcgtgaacgacatttgttgagaagagaaagattacaccgcgtattacacatccttgggttcctccctccacactatgacgcccaaatagattttactaaaagatacggtaaatttatagataatgcagaaccaaaaatagcatacaataatggaaatttcatcttcatgaactcatttaatgaaatgattgaagactttaagaaataccaacctcaattattctataagaaatctaatggagaagaatcaaaaataccctatgattggacaatatattatttaaggaagaaagtactgtcacagaaaattacccaacaagaattagcttggctaatacttcactttaatcagaaaagaggatactaccaactaaggggagaagaagaaacagaaaatccaaataaagaagtcgcattccacagcttaaaagtagtagacgtagaagcggaagctcccaataagaaaggcgaaatatggtacaccatacgcttggaaaatggatggatatacagaaggaccagcaaaataccactcgacgattggaaaggaaaaactcgagatttcatagtcactacagacctcaacgacgatggaacaataaaagtagataaagaaggcaaagagaaaagatcatttcgagctcctgatgaaaacgattggaaccttctaaagaagaaaacggaacatgacatcgacttttccggcaaaactgtaggcgcctatatctatgatcatctactacaaaaccccaaccagaaaataaaaggaaaactcgtaaggacaatagaacgaaaatactacaaagacgaactaaaagcaatactcgctaaacaaatagcacttcaaccagaacttttcacagaaacactattagcagactgtatcagggaattgtatagaaagaacgaaacccaacaacaaaatctcctttctaaagatttcctacaccttttcgttgaagatataatattctaccaaagaccccttagatcaaagaaatcaacaatagcgaattgtacactagaaaaacgtagctacatagataaagaaacgaatgaacgaaaagacacattcatcaaagtatgcgccaaatccaatccatattatcaagaatttcgagttctacaatggctacaaaaccttcgaatatacgaaatagaaacagatagggaagtcaccgcagaatttatagaaacagcagaagactacgaagctctatttaacttccttatgtcacaaaaagaaatagacaatgaaggactactcaaatacttcttgttcgcgaaaaacccccaaataaaagataaagttgcaaaaagtgagcttaagaaatggctaaccacataccgatggaactatgtttatgacgcagcagacaattcatccaagaaatacccaatgaacgaaacaggatacgacctacaaagatatctacaaaaagttgaaggcctaccagcaaactttttaactttcgatataacatatagactatggcatttattatattcagttaaagacaaagtcgagttcgaaaaggctttaaagaaatttgcacaagaataccaactcgacgaagctagctttgtagactcattcaaaaatttcaaaccttatccaaatgaatacggttcattctccgaaaaagcaataaagaaacttctaccgctaatgagattcggaaaccactgggacttcaacagaatagatgtaagtacacagaaaaggatcgatgatttaatcaacggcgtcgccaatgatgagataagaactattatacgcgaaaaagcagaaaaatatcaacttaactcagaaagttgtttccaaggacttccattatggttagcacaatatgttgtatataacagacacgcagaagcgaccgacatagaaaaatggacaagtgtatcggacttagaaacttacctagaagactttaaacaacattcgctgcgtaacccgattgtggaacaagtagtaacagaaacacttagggtggttcgtgacatatggcaacagtacggtggaggtcaagcaaactttttcgatgaaatccatatagaattaggccgagaactaaagaaaacagcagaagagagaaaacaactaagcaacaggaaccaagaaaatgaaaatactaacctacgcatcaagaaattactcgctgaactaaaagaagacgcaagtatccaaaacgtccgaccctactctccagtacaacaagaactcttaaaaatttacgaagaaggtgtattttcgtcaacagaccaggtagaagaagatatacagaaaataagaaagaaagcagaacctaccaccccagagatacaacgttataaattatggctcgaacaaaaatataaaagcccttacacaggagaggttattagtttgactaaattatttacagaagaatatgaaatagaacatatcataccgcaatcacgatattacgacgacagtctttcaaacaaagtgatatgtgaatcagcagtaaacaaactaaaaacgaaccaactcggtttagagttcatacaaaaccatcatggagaaaaagtgcgcattacagggaataaagaagtcacaatatttaccgaagaacaatataaagagttcgtgaagaaacattatgcaaataattcagctaaacagcaaaaattactcttaaatgagataccagagaaaatggtagcgagacaactaaacgacactcgttacatatcaaaatacatcagcgaaatactaagcaaaattgttagaagcgatgaaaaagatgaaggagttaacagcaaaaatgtaattccctgcactggcaaaataacaacagcattaaaacaagattggggactaaatgacgtatggaatgagcttattctaccgagattcgaaaggatgaatcaacttactcaaacgcaactattcaccagctataatgaccgattccagaaaaacctgccaacggttccaatcgaatatagtcaaggtttccaaaagaaaaggatagatcatcgacaccacgctatggatgctttggtaattgcatgtgctacaagagaacacataaactacatgaacaaccaacatgccttagacaaaaataaagataagaaagaaaaacagcaatcaagaatagacctgagaacgatcctctgtgagaagaaaaataacaactggcaatttaagaaaccttggtcgacattcacgcaagaaacaaaagaggcgctagaacacatagtagtatcatttaaacaaaatctccgcgtaataaataaagctactaattattacgaaaaatgggaagagaaaaacggcgttcttgtcaaaaagaaagtaaaacaagaaggaactaattgggcaatcagaaaaccattacacaaagaaaccgtgagcggaaaaatagtcctagacagaaaaattggaaaagataaaatattaacagctactaggaaagaagtggatataacatttacagagaaaataatctccagtataacagacaccgggatacagaaaatactactaaattacctaaattataaaggaagtcccgaagtagccttcagcgcagaaggattagaagaactaaataaaaacatagcccaatacaatgacggtaagaaacatcaaccaatatataaagtacgtatatttgaggaaggatccaaatttccactaggagaaaccggcgcaaaagctacaaaattcgtcgaagcagcaaaagggaccaatctattctttggagtttaccagggcaaagagaaaagatcctatgcaacaataccactcaacgaagtaatagaacgacaaaaacaaggactcccatcggtaccagaaagaaatgaaaaaggggaacccttattattctctctttctccaaatgatcttgtttatgtcccgatggagggagaaatagccgaaactatcgatttcaataatttaagcaaagaacagaaagaacgaatatataaaactgtatcgttcacaggaaaccaatgcttctttgtacaagaagcagtagccacccccatagtgaataaaatggaatattcaccattaaataaaatggaaagagacatattaggaacaatgattaaagaagtatgcattaaactaaaagttgaccgcttaggaaatatcacaaaagcatga

SEQ ID NO: 9179 - RNA, 4353 nt, synthetic construct
  misc_feature 1..4353: note = Cas9 variant
  source 1..4353: mol_type = other RNA
atgaaacacattcttggtttagatctaggcagtaatagtataggctgggcttttgttcaacaagactttgaaaacaaacagggcaaaataatagcagccgggagtagaataatccccatggaccaaaaaatgttatcaaacttcgaagaaggtacgacagttagccagaccgcagaaaggacaacatacagaagtatgagaagacttagagaaagacaccttttacggagagaaagactccatcgtgttctccacatattaggtttccttccgcctcactatgatgcacaaatagattttacaaaaagatacggaaaatttatcgacaatgccgaaccaaaaatagcgtacaacaatggcaacttcatatttatgaattcattcaatgaaatgatagaagatttcaaagaacaccaaccacaattattctataaaaaaagcaatggagaagagagtaaaataccatatgattggactatatattatctaagaaaaaaagcactatctcagaaaatcacacaacaagaactagcatggttaatactccacttcaaccaaaaaagaggatattatcaactaagaggagaagaagaaacagaaaatcctaacaaagaagtagcatttcactcattaaaggtcgtcgacgtagaagcggaagccccaaataagaagggggaaatctggtacaccattaggctcgaaaacggctggatatacagaagaacatcaaaaataccactagacgactggaaaggaaaaacacgagacttcattgttacaacggatctaaacgatgacggtacaataaaactcgacaaggaaggaaaagaaaaacgatcttttcgagctcccgatgaaaatgattggaacctcttgaaaaaaaagacagagcacgatatagacttcagcggaaaaccagtcggtacctacatatatgatcaccttctccaaaacccaaaccagaaaatcaagggtaagttagtacgaacaatagaaagaaaatactataaggatgaactaaaagccatactagcaaaacaaatcgcactccaacccgaattatttaccgaaactttacttgcagattgcatccgcgaactatatcgaaaaaatgagacacaacaacaaaatctactctcaaaagacttcttacatttatttgtagaagatataatattctaccaaagaccattaaggtcaaaaaaaagtactatcgcaaactgcaccctagaaaaacgaagctatatagataaagaaacaaacgaaagaaaagacacaccaatcaaagtatgctcaaaaagtaatccatactaccaagaatttagagtgttacaatggctacaaaacctacgtatatatgagatcgagaccgatagagaagtaaccgccgagttcatagaaaccgcccaagactacgaagcccttttcaactttttgatgtcccaaaaagaaatagacaatgaatcattactaaagtattttttattcgcaaagaacccccaaataaaagataaaaccgccaaaatagaacttaaaaaatggataacaacatacagatggaactacgtatacgatgtggccgacaactctagtaaaaaataccctatgaatgaaactggctacgacctacaacgatacatgcaaaaagtcgaaggccttcccactaatttcctgacctttgacacaacttacagactctggcacctactctattcagtcaaagataaagtagaattcgaaaaagccttaaagaaattcgcaaaaaaaaaacaactagataaaacgtctttcgtcgattcattcaaaaacttcaaaccgtatccgaacgaatacggctccttcagcgaaaaggcaattaaaaaactattaccattaatgagattcggtaaccattgggattttaacagaatagatgttagcacccaaaaacggatcgacgacttaataaacggagtggccaatgaagatatacgaacaataatccgagaaaaagccgagaaataccaactaaactcagaaacatgcttccaagacttaccactatggcttgcacaatacgtagtgtacaatcgtcacgcggaagccaccgatattgaaaaatggacatccgtaagtgatctcgaagcttaccttgaagattttaaacaacattctctacggaatcctatagtcgaacaagttgttactgaaacactcagggtggtcagagatatatggcaacagtatggaggaggacaagccaacttttttgatgaaatacacatagaactaggacgagaactcaaaaaaactgctgaagaaagaaaacaactaagtgataaaaatcaagagaatgaaaatactaacctacgtataaagaaattattagctgaattaaaggaagatgccagtattcaaaacgtcaggccttattccctcgtacaacaagaactgttgaagatttacgaagaaggggttttttcctcaacggacgaaattgaagaagatatccaaaaaattagaaaaaaggtagaacctaccaccccggaaatacaaaggtacaaactatggctagaacaaaagtataaatcaccttacacaggagaagttatctcattaaccaaactcttcacagaagagtatgagattgaacatatcatcccacaatcaaggtactacgacgatagcctaagtaacaaagttatatgtgaatctgccgttaacaaacttaagactaatcagctcggtcttgaattcatacaaaaccatcacggagagaaagttagaataaccgccaataaagaagtcacaatcttcaccgaagaacaatacaaagaattcgtcaaaaaacattacgcaaataattcagccaagcaacagaaactcctactgaacgaaataccagagaagatggtcgcccgacagcttaatgacacccgctacatatcaaaatacatttcagagatactctctaaaatagtaagaagtgacgaaaaagatgaaggagtaaactcaaaaaatataatcccatgcacaggcaaaataacaactgcactaaaacaagactggggactaaacgacgtatggaatgaactaatactacccagatttgagagaatgaaccaactcactcaaacacaattattcacttcatataacgatcggttacaaaaaaatctaccaacagtaccaattgaatatagtcagggtttccaaaagaaacgcatagaccatagacaccatgcaatggatgctctggttatagcttgcgctacacgagaacatataaattatatgaacaaccaacacgcgttagacaaaagtaaagacaaaaaagaaaaacaacaaagccgaattgatctaaggactatattatgtgaaaaaaaaaacaacaactggcaattcaaaaaaccttggagaacattcacccaagaagcaaaagaagccttagaacatatagttgtaagtttcaaacaaaacttaagagtaatcaataaagcgacaaattattatgaaaaatgggaagaaaaaaatggggtacttgttaaaaaaaaagtcaaacaagaaggtacaaactgggcaatacgtaaaccactgcacgaagaaacttttagtggcaaaatatctctgaatagagaaaaggtaggaaaaggaaacatattaacagcgacaaggaaagcagtagacagctctttcgatgtaaaaaaaatatcaaaaattactgatacgggaatccaaaaaatattattaaattatctaaaatataaagggtcgcctgaagttgccttcagcgctgaaggactcgaggaacttaacaaaaacatagcacaatataacaacgggaaaaaacatcaaccgatatataaagtaagaatatacgaaaaaggctctggaaggttcgtattaggtgaaaaaggcaccaaatcaaagaaatatgttcaaggagcaccaaacctatattttggggtgtatcaaggaaaagaaaaacggacatacgctactatacctcttaacgaagtaatcgaacgtcaaaaacaagggttaccatctgtaccagaaagaaatgagaaaggcgaaccattgttatttagcctaagtccgaacgacttagtatacgtccctatggaaggcgaagcaacagaaaccataaactttaataaccttaataaagaacagaaagaaaggatctacaaaaccgtatcattcacaggaaaccaatgcttcttcgtacaagaagcagtcgcgtcacccatcgtaaacaaaatggaatacagtcccttaaataaaatggaaagaagtattgtaggcatcatgataaaagaagtatgcatcaaactaaaagttgataggctaggcaatattacgaaagcatga

SEQ ID NO: 9180 - RNA, 4362 nt, synthetic construct
  misc_feature 1..4362: note = Cas9 variant
  source 1..4362: mol_type = other RNA
atgaaaacagtacttggactagacttaggtactaattcaattggctgggcactaatacaacatgatttcgacagcaaaaaaggagaaatattaggaatgggaagtaggatcataccaatgagccaagatatacttggcgaattcggaaaaggcaacagtgtatcccaaacagcagatagaacgaaattcagatcagcacgaaggctgagagaaagacatttacttagaagagaaagattacaccgagtcttaaacattcttggattcctacccagacactatgccgcagatatagattttgaaaaaagactgggtcaattctttgaaggcaaagaaccaaagctagcctacgataataatcaatttatatttactaaatcttttggtaaaatgctagcagatttcagacaacaccaaccagacttcctgaaggatgaaaaatctaacgacttgctaatcccgtacgactggagtatctattacctacgtaaagaagcactaacaaaaaaaatagaaaaagaagaattagcatggataattctcaactttaaccagaaacggggttactaccaactgcgaggcgaagaagaagaagagaatttaaataaactcgtagaatttcattcactaaaaatcatcgatgttgtcgcagatgaaaaattaaataacaaaggtgaaacatggtactcgttactactagaaaacggctggacatatcgacgatcatctaaagtaccacttttcgactggaaagaaaaagtacgggactttattgtgactacagacataaatgatgacggttccgtcaaaacagacaaagaaggcaatgaaaaaagatcctttcgagcaccatctgacgacgattggacactattaaaaaagaaaaccgaacaggacatagataaatcgagaaagcccataggtgcatacatctacgatgctatcctaaaaaacccaaaacaaaaaatcaatggcaagctcgttagaacagtggaacgaaaattttacaaagaagaactgaaactaatattacaaaaacaaaaggaattccacccggaattacaatcgacagacttatacaacgaatgcatcagagaattatacaaaaataacgatgcacatcaactacaactaaataaaaaagacttcgttcatctatttttggaagatataatcttttaccaaagacccctaagaagccagaaaagcagcgtcggaaattgtccactagaattcaggaaatttaaagactcagaaggcatcgagaaagtagaatatctcaaaacaatccctaaaagcaacccatattttcaagagttccgcatatggcaatggatgtataacttaagtatctataaaaaagacgatgacgaaaatgtgaccagagatttcctcaaaacaatcgaggactgggaggatctgttcgaattcctaaaccatcgaaaggacatcgaacaagaaacactattgaaatttctattgggcaagaatggagttaagggaaaagcactgaaagtcgaagcaggaaaattcagatggaattacgtatcagataaaatatacccatgtaacgaaacgaaggcattaataatttcaaaactagaaaaagttaaaggcgtggaagaaaaatttttaaccgaagagatagaatataagctatggcacttaatctactcagtaaccgataaagtggaatacgaaaaagctttaaaagcattcgcagggaaacaaaaactagatttagtctcattcgtagactcattcaaaagattcccaccatttaaaaatgaatatggggcttactccgagaaagcgataaaaaaaatactaccactattaagaacagggaaaagttggaattggatggcaatagactcaaaagtaagagatagaatcaacaaaataataacaggtgaattcgacgaagagattaagaataaagttcgagaaaaagccgaaaagcatagtttgaaaaaagaaaatgactttcaaggattaccactctggttagcacaatacgtagtctacggccgccacagcgaagcaagcttcagtggaaaatggaacagtgtagatgacttaaaaaagtatttagaagaatttaaacaacatagtctaagaaatccaatagtcgagcaggtcttaacagaaacattaagggtcgtcgcagatatctggcagttctacggtaaaggagagaaagatttttttagcgagatacacatagaactcggaagagaaatgaaaaacacagcggaagatagaaaagaaatgtcagcgataatacaagcaaacgaaaccactaacctacgaatcaaagcacttcttaatgaactactacaggataaaaaggtggaaaatgtaaggccctacagcccatcacaacaggaaatactcaaaatatatgaagatggcgtactaagctcagatatagaaataccagatgacatacaaaagatctctaaagctgcacaaccaaccaagtcagaactccaaagatataaattatggttagagcaaaaatatagatctccatatacaggagcaatgataccactagggaagctattcacatcagaatacgaaatcgagcacataataccccaatcactttacttcgacgactctttctcaaataaagtaatctgcgaaagcgctgtaaataaactaaaagactcaagacttggaatggaattcataaaagaatgtcacggtatggttgttgagacaggcttcggaaaatcagtaacagtattcgaagaagaaacatacagggactttgttgtacaaaactattccaaaaatcactctaaaaaaagtaaattattactagaagagatacctgaaaaaatgattgaacgtcaaatgaatgatacgcgatatataagcaagttcataagctcagtcctaagcaacatcgtaagggaagaagtcaacgacgacggtgtaaacagcaagaatatcgtacccggaaacggaaagataactacccaactaaaacaagattggggtttaaatgatatatggaacgaactaatattgcctcgattcgagcgactcaatgtactgaccgacagtaaacattttactgcatggtccgaaaaccaccaaagactactacccacagtaccaattggactatcaaaaggattttctaaaaaacgaattgaccacagacatcacgcattagatgctttagtaatagcatgcgcatctcgaaatcatatcaattttttaaacaacgctcatgcaattgacaaaaaaaaaaacagtgaagaaaaacagaaattcagacatgacctaaaggccatactatgcgataagaagtattcagacaaatcagaaaaaaactatagatggatcttcaaaaaaccatgggataattttacaatagacagtaaaaatgctctagacaaaatcatagtctctttcaaacaaaatttacgtataataaataaagctactaacagatatgaaaaatgggtagaccgagatggaattaaagttaaagaatggcataaacaagaaggtataaactgggctacacgtaaaccattgcacaaggacacggtgagtggtaaggtagatctcaaaagggtgactgttcctgaaggtaagatattgacagctaccagaaaatcactcgacaccagctttgacttaaaagttatcgagagtataacagacacaggtatccaaaaaattctaaaaaactacttaacatctaaatctaacaatccagaattagctttctcatccgaaggagtagaagatatgaacaaaaacataagaaaatacaatgacggcaagttacatcaaccaatatataaagtgagaatattcgaactgggtagtaaatttcctttaggacaatttggcaataaaaaatttaagtacgtagaaacagcaaagggtactaatctctttttcgctgtatacgaagatgaaaacaaaaacaggaattatgaaacaatcccacttaatgtagtgatagaaagacagaaacaaggcttaagtagtgtaccaattaaaagtgagaaaggtcacaaattactattttatcttagccctaacgacattgtatatgtaccaggaagtaacgaagaattttccatcgaccgattataccgttttaccgactcatctgacaaaactgcaaactttattccattatcagtctcaagcctgatcttttcatcaaacaaaaacgaacaaaagaaaataggaatttcatatccaatacaagatgaatttggtctgggatcgccacaatcaaagaatcaaaaaagcatagatggaataatgatcaaggagaaatgtgtaaaagtgaacatagacagactaggaagagtaagtttctga

SEQ ID NO: 9181 - RNA, 4368 nt, synthetic construct
  misc_feature 1..4368: note = Cas9 variant
  source 1..4368: mol_type = other RNA
atggcaaaaatattaggccttgacctaggaacaaatagtataggttgggcagttgtagaggatcaaaataacaaaacgacactgatcgacaaaggagtaagaatctttagtgaaggagtgaaaatagaaaaaggtatcgaaaaaagtaaagctgcagaacgcactgatttccgaagtgccagaaagataaagttcagaagaagactacgtaaacaggaaacattaaaagtcctaatagagaacaatatgtgccctttaacaatcgaagaatggaccaagtggaagaaagacaaaaaagaatacccaaaaaacccggatttcattaactggttgaaaaccgacgaattaaaaaacatcaacccatacttttttagagacaaagccagcagaacggaactaccactaatgcaaacaggaagggcactatatcacctagcacaaagaagaggtttcttgagcaatagactcgatcaaggatctgatggttttacagaacagatacgccttgatctgataaaaaaaatagaatgcgaaactgataaaacagaactgctcactagcgttcaatctataattgacacctatagcgaagaagaggacaaagacgccaaaaaattactaaaaggagtagaaaaactttgtaaaataaacaatgaattaccaataacggaatttaaagaaaaactaataaattacctcaacaaggcagacaaccttggcgctgtcaaaaaaggcatagctgacgtaagtaaaaaaataacagaaactgggtgcgaaacgctaggacaatatttctacaagctttaccaaaatcagtccaaaataagaaaagtgtacacagcccgaacagaacactactaccatgagtttctaaagatctgcgaaacccaaaatatatgcgaccaattaaaacacaaactagataaggcaatattttaccaacgaccactcaaatcacaaaaaggacttatagggaaatgtgtttttgaaaaaaacaaaacacggtgtgcagtaagtcacccagcatacgaagaatacagagcattacaatttataaattccattaaagtaagcgaaacaaaggacggcaaaaaagacttcttatcgtttgacgaaagaaaaaaaatatggcctaaattcataagaaaatcaaaacccaatttcgacttcaaagagattgctgaaacattagacaaaaaaggtttaagcagatattacaactacacgggtcatacgtcagtatcgggatgtccaacaatagctcaactaacaaacatattcggagaaaattggcaagagacacttttcgaaaaatacactaacaaacaaaatacgaaaggactaaaaactattgatgaagtagtaacagatatatggcatgtactctttacatttgataaagacgaaaaaattattgaatttggtaaacaaaagttaggactgaacgaagttttggcaaaaaagttcggagcaataaacctaaaaaaagattatgcatcattatcgctcaaagctataaacaaaatcttaccatacttgagagaaggattaatatattcatatgccgtttttctcgctaacatagaaaacgtcgtaggggaagaaatctggaaaaacgacgaaaacaaaaacctgattaaaaaagagctacatttattgatagacaattttaatgaaataaaaggcctcgaagcagtagtaaacgatttcatagcagattttaaaaaagaatacaataatgctcacaaagactacgtactcgatgaacaggacaaaaagatactactagaaaaaatagaatcgaactacggaaagaataaattcgaatcgttagaaccagacaaaaaaacagagataattaacagtacagagaaaatggtagcagaacaactacgcaaacaaagaggtgaattcataaagcctaagagactagatgaaaaaataagtgaattcttaattaataacttcaacgtaacaaaaaagagcatcgcccgattataccacccttctgacgtagaaatctttaaaactgccagccgcaattcggaaggtcttctactacttggaagcccaatagtctcaagcataaaaaatccaatggctatgagagcgatgcaccaattgcgaaaactagtaaatacacttataaaagaaaatatcatcgatgaagaaactaaaatcaatatagaattagcaagggaactgaacgacgcgaataaacgggcagcaataaagaaatggcaagatgaaagacaaaaagctcgggaagaatataagaaatccataaaggaactctttaaagccgaatgtggtaaagatatagaaccaagtgatagtgaaatattaaaatacgagttatgggaagaacaacaacacatatgtatttatacaggcaaaacgattaatatttgcgactttatcggagcgaacccaaacttcgacattgaacatacaatacccaaatctttatgtttcgacaattccaacgaaaacctaaccttatgtgacatacaatataacagagacgttaaaagaaataaaataccaacagaactaagtgactacaattctataaaacctaggctagataaatggttagtctttatagatgactacgaaaaattgtataatacacgaaaaaaagcaaaaggtatagaaactaaagaacaaaaagataaaaggataaaggaaaagcactactacaaactccatctagactattggaagggcaaatacaaaagatttataatggtagatgtcccatcgggattcaaaaatagtcaaattgtagatacaggcataataacaaaatacgctatatcatatatgaaatcaatcttcccaaaagtgtatagcgtaaagggaaatatcgtagctgagtttagaaaaatctggggactacaaaatgactatgaaaaaaaagaaagggtcaatcacgtccaccactgcatagatgcaataactatagcctgtatgtcaaaacaaaaatatgacaccttggccaaaatctatcacgaagatgaagccggcttccacaaaattaaaaaagaaacccagttggtgtctaagccgtggacatcattcaccatggatgtcttaaacatagaaaaagaaatattcgtaagtcatcatacacccgataatatgaaaaaacagagcaaaaaggtcgttcgcgaaagaggaataatagcaccaaaagtaatctacgaaacggatgcaaataataacaccctaagggacaaatacggcaaaaaaatcgtcaaagaatacattttattgaaagatgtaaacggtaacctcatcccaatcaaaggaaaacgtttaacgccttcagacataatcaacaaagtcgatggtattgattatttcagtctgataataaacgataaaatacagtattatgagttcgcaaaatccaaaaaaacaggaaagataatctacaaaaaagaaccaatatatttacaaggtgataccgtaagaggaagcttacatttagatacattctacggagcgatagcaaaagacattaacggtaatatcataacgaatacaaacggaaagatcgcccctaactatgtcataagaaaagaattatcgaaactaaaagaaactgacatagagaatattgtggatcccgttgtgcgaggaaaaataatcgaagctaagaaaaacaaattgattacattcaataagtcaggagccgtaattaaaacaaccatatggatgaaagaaaatcaaatacccatcaataaggtaagagtatacagttcattaaaaaatccattacctgattttaagaaacacagagatctttctcacctcacgtacaaacaacaatacaatgtcagcaatgaagaaaattactgcctagcaatatatgaaggcaaaaacaaaaaaggcaatgtctgcagaacttgtgaacttgtcaacatgatagacgctggtaactattatagactatctaataaaaattggaagcaacaataccccatagtacccgaaaaggatagtgtaacaaactacagcttaaaaactataataacaaagggcctaatggtattattatacgaaaaaagtcccgaagaaatatgggaattaacctataaccaacagatggaaaggttatacgaaattacacaactcgatacagagaaatctgccgaaatcaaactactttttcatcaagaagctagagagaagaaggtgattacagaatacatgggcttaaaaaccggaatgaaaggaggtaaaaatataggaaaacacaaagaattcccatggataaaggtagggcccaactccttcgacgccttaatagaaggaatagattttaaattaacacccacgggaaaaataataaagttgtga

SEQ ID NO: 9182 - RNA, 4374 nt, synthetic construct
  misc_feature 1..4374: note = Cas9 variant
  source 1..4374: mol_type = other RNA
atgaaaaccatcttaggattagatttaggaacaaattcaatcgggtgggcaaaagtttcggtagatgactacggcaactacctgcacgacataaaattaggctctagaataataccaatgtcacaagacgtcttaggaaattttgatagtggcgtaacggttagtcaaacagctcaaagaacagagtttagatcaaaaagaagattagtacaaagaaatttacaaagacgcgaaagattacatagagtattacatgtcctagatttcctaccggcacattacgatgcggctataggatgggatagaacagaagccgttacttacggaaaatttcttaatcatgcagaacccaaactagcatgggaggaattaggtaatggaaaaagaaggtttctatttatggacagctttcatgaaatggtcgcagactttgctagatgccaacccgcactcgtagctgacggtaagaaaattccactcgactggactatttattatctcagaaagaaagcattaacacaagcgataacaaaagaagaactagcatggatactgctcaacttcaatcagaaacgaggatattatcaattaagaggggaagaggaagaggaaaatcccacaaaacaggaagaatattacgaacttaaggtagtatccgtagaagctacagattcaaggaaaggaaacgatacttggtacaacgtacatctagaaaacggctggatatatagacgaagctccaaaattagcttggacgattgggtaggaaaagtcaaacaatttatagtaacaacagagtatgagaaagacggcgcaacgttaaagacggataaggaaggatatgttaaaagatcatttcgagctccaaacgaaaatgactggggattaagaaagaaacgaacggagacgctcctagaaatgagtgggaaaactgtaggcgcttttatatatgaccacctattacaagagccagctgataaaatacgcggaaattttataagaacaatagaaagacattattacaaagcagaattagaggctatattagcagaacaatgtaaataccacatcgaacttagagataaagaaatgttagaagcatgtgcaagagagttatatctcaacaatctgcctcaccaacggagcttaatgaagaaagatatgacatacttactactatatgatttaatattttatcaaagacccctaaaatccaagaaagcattgatagcgaactgtccgtacgaatattacgaatatgtagacaaagaaacaggagaaataaaaagacagaatatcaaatgcatagctaaatcaaatccttattttcaagaatttcggctatggcaatttgttttaaacctgcggctattcgacagagtagaagacaaagaagtcacagcaaattacctaccgaccgcagacgatcacgcaagactttttacctatttaaacgacagaaaagagattaaccaagaaacactactaaaagattatttcaaacttaagaaagtaaaaattggaaatgaaaaagaatatccaattagatggaactatatagaagacaaagaaaagaaatatccttgcaatgagacaagatacgagttactcatggcgctagatagagcgggaatcgaacataaatggttagatgacaataacctagaatacaggttatggcatttactatactcggtagaagttaaatctgaaagcgagaccgccctcagaaaactcaaaaacgatgatgcattcgtaaattccttcttaaaagtcaaaccattcaagaaagaatacggagcatattccgaaaaagcaattaaaagactgctagcagttatgcgaaaaggattcctatggaacgagcaagatatttgcgatgaaactagaaaaagaatagaaataataattaaaggtgacgtagatgaaaaagtaaaagaaagaatgggacacgctgcatatagctttgatagagtatcagactttcaaggcttaccggaatggttagcatgctacgtagtgtacggacgtcacagtgaggccatggatatccaacactgggactcacctgaacgattaatggcttatataaataattttaaacagtattccttaaggaacccaatagtagaacagtgtattctagaaactcttcgcaccgtacatgatatttggaaagaaacaggacagatagacgaaatacacgttgaattaggtagagaaatgaaaagcacgagcgaagagagagctcgtcgcacacaaaatgttttaagaaacgaaaacacgaatctaaggataaaatccttattgatagagctcaaaaacgacacagatatatgcaacgtacatccttatagcccaatgcaacaagaaattctacgcatttatgaagaaggtgccctacaggaactaaatagagaagatgaagatttcgaggaaatttcaaaaatatcacaaatgtcccaaccgagcggaaaagagctaaaccgatataaactatggcttgaacaaaaatatcgctcaccttatacaggaaaagcaatttcattagcaaaactatttacacccgcatatcaaattgaacacgtaatccctcagagtagatatttcgacgacagttttacaaacaaagtgatctgcgaagctgaagtaaacacactcaaatctaacctacttggatatgagtttataaagaaacatggaggagaaataatacattgcaccacattaggcgacgtaaggatcttttcggaatcagaatataaagcatttgtgatggatcactacgcaaataataaatccaagaaagacaaactccttatggaagacataccacaagagttcctttcaagacaaatgaacgatagtaggtacataagtaaagtagtcaaaacgttactttccaatatcgtacgaatggctgacgaatctgaagcaacaagtaaatcggtaattgtgtgtactggcggggtaacagataggcttaagaaagactgggggttgaacgatgtatggaatagcatagtatattctagatttgaacgccttaacaggttgacaggaacagaagcattcggacattgggaaaataaagacggaaaaagagtcttccaaacatccatgccattagaactacaaagaggtttcagaaagaaacgaatagaccatagacaccatgctatggatgcgttggtgatagcatgcgcaagccgaaatatagtaaattacttaaacaacgaaagtgcaaacaacccaaagaaaagggaagacctaagacgccaattatgcgacaaaaacagagtgatacgcaaaccatgggaaacatttacacaggacgcttacaacgcattagaaaatgtcgtcgtgtcttttaaaaactacgtaagggtaattaacaaagcaacaaatagatacgagcactacgatgaaaatggaaagaaacggttcgttcaacaaaaaggaagcgagctttgggcaatcagaaaaccaatgcataaagaaacatactatggacacgtgaatctaaggaggaaagaattagtaactttacaaaaagcactagatgatataccttccatatgtgacaagaaactaagagattatatatcggcattagtagaaaaacacttcaacaaaagacaattacttgcgcacttcaaaagtacagactactactggcaaaaacaatatgttaataaagtttacgtctggactttttctgatgacataaaacccctagtagcaacaagaaaactgttagatacctcattcgacgctaaaagaataggaacaataacggacacgggaatccagaaaatcttacgcaactatctagaggccaaaggcggaaatgccacactagcattcacgccagagggcatcgcagaaatgaaccagaatatttcaaaatacaacgacggaaaaccacaccagccgatactaaaagtacgcataacagaacccatgggtgcaaaatatagagtaggacaaactggtaataaaatggcaaaatatgtcgaggcgcaaagcggaacaaacctatactttgcgatatatgaagattctgaaggaaaaagaagctacacaacagtccctttagatgaggtagccgaacgactgaagcaaagattaagccctgtaccagagaaagatgaaaacgatgtaccactaaaattctatctttcacctaacgatctagtatatgtgccaacagaagaagaattacaattacgagagtgcaaacttaacaaggatcgaatttacaaaatggttagttcaaccggaaatgagtgtcatttcataccatactacgtggcaaacgtgatatacaacaagggcgggtttaacatgcaaatgcacagaccacaatcatga

SEQ ID NO: 9183 - RNA, 4374 nt, synthetic construct
  misc_feature 1..4374: note = Cas9 variant
  source 1..4374: mol_type = other RNA
atggctaaaattttaggattagatttagggactaatagcatagggtgggcaatagttgagaaaaacaacagcgatttcacacttatagataaaggagtacgaatattttccgaaggagtaaaaaccgaaaaaggaatagaaagatcaagagccgcagaaagaacaggatatagatcagctagaaaaattaaatacaggagaaaattaagaaaatacgaaacgttaaaagtattgagcaaaaacagaatgtgtccattacaaatagaagacgtagaagcatggaagaaatccggatttaaagactaccctttgatacctgaatttctacaatggctccgcaccaacgaccatgaaaacgtaaatccttacttctttcgagacaaagcgtcacgagcaaaagtatccctgtgggaattaggccgagctttttatcatatagcacaacgaagaggattcctaagtaaccgcttggaccaatcaagtgaaggagtgcttgaagaacacaacccccaaatacaatcattaatagaagatttagaagaaacttcaacgattttaaacgaagttagagattattacataaaccttggcctacttgacggagttaaaggagacttcaagaaagaactcgacgaaggtgagaagaaattaaaatccctatacaacacactcatagctataattaagaaaaacgaaaacgatgtacaaaaatgcaaagacgaaatcataaaaagactaaataagaaagaagacctaggaaaagtaaaaggaaaaataaaagatatatcacaagcaatgttagatggcaatttcaaaacactagggcaatatttctattcactctacaataaaggtaaaataagaaatcaatacacatcaagagaagaacactacttacaagaatttattacaatatgtaaagttcaggggataaatggtatcaacgatgaagaaatcctaccagaaaagaaatttactggcttggctaaagatctgtataaagccatatttttccaaagacccctaaaatcacaaaaagggttaataggaaaatgctcattcgagaaaaataaatcaagatgcgctatctcacaccccgacttcgaagaataccggatgtggaactacctaaatacaatcaaattcggcacgcaatcagataagaaactccgattcttaacacaagaagaaaaattgaaactgattcccaaattctataggaaaaacgatttcaatttcgaagtacttgccaaagaactcatcgataaaggtgccacctttggtttttacaaaagttcccggaaaaacgagttcttatactggtttaactacaaaccgacagacactgtaagcgcctgtcagttcagtgcgagcctcaaaaacgcaataggagaagattggcaaaccaaagtctttacttataaaacactaaattctgagaagaaagaagtaataagaacagtagattacagagacctttggcaccttctctccgcaagtacttcagatatctacctctatgaatacgcaaaagaaaaactaggcttagaggacaaatcagccaagacattctcaaaaataaaactaaagaaagactttgcatcattaagtttatcagcaataaataaaatcctcccatacataaaagaaggactactatatagccacgcagtatttatggcgaacatcgaaaaagtagtagacgaacacatatggaaagatgtaaaagaacgaacgattatacaaaacgaaatctcgaaaatcataaaatccgatgtattcgaaagagaagtaataaacataataaacggactaatcaaaaactctaaaacagaaggcgagaactacgcagaagaatcgaaaaatatttttaagacagagttcgataatgccatcgcaaaaatatttgagaaaaataacgacatcgagttcaaccagccctttttagatgacacctatcttaaatatgtcgaagaactaaagaaatttgataaagcgagatcatttttacctgtgccaaggcttgacgaaaaagtcattcaatttttattaggcaataacaaggatggaatggtatactgctctgacaaaaataaaacaaagaaattataccacccatccgacatcgaaatattcaaaaagaaaataattaaagatgaatttggcaacgagaaaatggtactaggaagtccattaacaacaagtattaaaaatccaatggctatgagagcacttcaccagctgagaaaagttctgaacactctcattttagaagaacaaatagacgaaaacactaggatacacatagaaatggcaagagaactaaacgatgcgaataaaagaaaagggattcaagactaccaaaacgaaaacaagaaattccgagaagacgcaattaaagaaatcaagaaactatacttcgaagaatgtaagaaagaagttgaaccgactgaagaagacgtccttcgctatcaattatggatagaacaagataagaaagaaatatacgaacaaggtaaaagcatacgaatatcagatataatagggagtaatccagcatatgacattgaacacacagtaccaagaagtatcagtcaaaacaattcactaatgaataaaactttatgcactccacgattcaaccgagaaattaagaaacagaaaatgcccatagaactatcaaattacgaagaaatattaccgagaatcgaacactggaagaaagaagcagaagatttaacacgacaaattgaaagcatatcaaaaagcataaaatcagcatccacgaaagaagcaaaagataaaaacatacgaaggcgtcattatcttacactcaaaagagactacctaaaaggcaaatacgatcgattcatctgggaagaaccaaaagtgggatttaaaaattcacaaatacccgatacaggaatcatcacgaaatatgcacaggcatacctaaaaagctacttcaaaagagtagaaagtgttaaaggtggcatggtggccgaatttaggaaacaatggggaatacaagaaagctatatcgacgaaaacggattcaaacactataaagaaaaagacagatcgaaacatacacatcataccatagatgcaataacaatagcatgcatgacaaaagataaatacgacgttttggcccaggcttggacatctgaagatgaacaagacaaacaaaaagcaaaaaccctaatgtctgaagcaaaaccatggaaaacattcaaagaagacatagagaaaatagaagaagaaatattagtctctcatttcacattagacaatgtcaagaaacaatcaaagaaaatcgtcagagtccgcgggaagaaacaatatgttgctgaaattgaacgagacgtaaacggtaaagcaatggcgaagaaagacgcaaacggaaaaataatctataaattaaatgaaaaaggcgagaaaataccacggctccaacaaggagataccattagaggctctctacatcaagattcaatctatggggcaatcaaaaacccacttaaccaagaagaaataaaatacgtcatcagaaaagatttagaatcattaaaagcgaatgacgtagataacatagttgacgaaacggtgaagcaaaaagtcaaagaagccatagaaaataaaatcttattactctcgtctaacgcacaacaaaagaacaaattagtcgacgacgtttggttaaacaaagaaaaacaagtacctatcaagaaagtaagaatttatgcaaacagcgttaaaaacccgcttgaaataaaagaacagagtctacttagtaaaagccgaaaagaacacaaacaaaaagtttacggacaaaacgacgaaaactacgctatggcaatctacgaattagacggcaaacgtgagttcgaacttataaataattttaatctagccaaacttatcaaacaaaaagaaggattctacccgctaaacaaggaaaaagaggttaaaggcaagaaagttctataccccatcgctaaaagtaactacagagatgtagtattaaaacgtggacaacaagtagtattttacgataaagaagtggaaaatcctaaagatatatcggaagtcatagacttcaaaggcagaatatatattatagaaggactctccattcaaagaatagtaagaccctcaggaaaaatcgacgaatacggagtcataatgctaaaatatttcaaagaagcacgaaaagccgacgagatcaagaaagataattacaagcccgacggcgtttttaaactaggagagaatcgaccaacacgtaaaatgaatcatagtcaattcacagctttcgtggaaggaatagacttcaaagttctgccaaccggaaaatttgataaaatatga

SEQ ID NO: 9184 - RNA, 4377 nt, synthetic construct
  misc_feature 1..4377: note = Cas9 variant
  source 1..4377: mol_type = other RNA
atgacaaaaacgatactaggattagacctaggaactaactccataggatgggccttaatcaaccaagacttcgataataaaaaaggcgaaatcctaggcatgggcagtagaataattccaatgacccaagacatcaaagacgaattcggaaaaggcaatagtatatcacaaacagctgaacgtacaagattgcgaggagtaaggaggttaatacatcgtactttactaagacgagaaaggctacaccgcgtactaaatataattggctttctaccagaacactatgcaaatcagatagactttgagaagagattcggaaaatttaagcccgagagtgaacctaaaataagttttgatggcaacgatgtatttttatttgaaaaaagttatcaagaaatgcttgtcgatttcaaaatacaccaaccgcaactggtttcaaacggaaagaaaataccacatgactggacaatatactatctaagaaaaaaagcactgtcgaaaaagatcgagaaggaagagcttgcatggatattactaaacttcaatcaaaaacgaggatactaccaactacgtggcgaagaggaagaagaaacaccaaataaattggtcgaattccattctctcaagattgttgaagttaatgcggatgaacctcaaaaaggaaaaccagaaatatggtactcattggtgttagaaaatggttgggtttaccgacgggcgagtaaaactcccctctttgactggaaagacaaaataagagaattcatagtaacgacggaaataaacaacgacggtactgtcaaaaccgacaaagagggcacagaaaagcgatcatttcgagctcccaaaccagaagactggacattacaaaaaaagaaaactgaattcgaactgtcaaaaagtgggaacgaggttggtgcttttatttatgaaagcatacttcaaaaacctaaccaaaaaatcagaggaaagctaatatcaacaatagaaagaaagttctataaagaagaattaaagacaattcttaaaacccaactgtttttccacaaagagctgaaagatgaaaaactatataatgcatgtatagaagaattatataaaaataatgaagcccatagatcactactgagtaacaaagggtttgaacatctattcatcaacgacatattattttatcaacgaccacttaggtcaaaaaaaagccagattagtaattgcccattagagaaacgaacttacaaaaaggaaggaattgaaataaccgaaggtattaaagttatttcaaaatcaaacccaatataccaggaattcagactttggcaatggatcagtaacctatcgctatactgtatagaaccaaccgagactaatgtaacatccacattcctgaattctatagaagactacgaaaatctatttgaatttctaaataacagaaaggaaatagaacaaaaacatcttctaaaatacttactagaaaaccaaggattcaaaggcaaactgctcacaaacgaattagaaaaattcagatggaatttcgttgcagataaaaaatacccttgtaacgaaacaggatcattattgcatacgcgcctgagtaaagttaaaaacatctctccggactttctaacaaaagaaattgaacaccaactttggcacataatttatagtgttacagacaaaattgaatacgaacaggctttgaaaacatttgcacgaaagaataacctcgatgttgacagttttttcgaacactttaaaaagatccctccatttgaatcaacatacggagcgtactcggagaaagcgatcaaaaaactactcccattaatacgattaggcaaatactggaactgggaggcaatagactctatatcaaaagatcgaataagcaaaatattatccggagaatacgacgaaaatattaaaaatagagtacgcgaaaaagcagttcacctaacaagcgaaaacaacttccaaggcctgcaagagtggctagcaaaatacatcgtatacgacaggcattcagaaggaaatgatctaggaaagtggacctcagtatctgatttagaaacttaccttaaagaatttaaacaacactctttgcgcaaccccatcgtagaacaagtaataacagaaacactaagagtcgtgaaggacatatggataaaacacggtaaaggtacagaaaatttttttgacgaaatacacgtagaactaggacgagaaatgaaaaataattccgaagataggaaaagactaacgaatacaataacagagaatgaaaatacaaacttaaggatcaaagctctattaatggaaatgatgaatgacaatgacgtcgaaaatgtcaggccgtatagtcccagccaacaagaaatactaaaaatatatgaagacggagcactaaacagtaacatagaactggacgatgaaatagtaaaaattagtaaaaaggcagagccaacaaagtcagaactacaacgatacaaattgtggctcgaacaaaaatacagatcaccatacacaggtcaagtaattcctctcaacaaactatttacaagcgaatacgagatagaacacgttgtcccccaaagtcggttcttcgatgattccttctcaaataaagtcatatgcgaaagtgccgtaaacaagcgtaaagataaccaactcggattacaattcattaaaaaccactcaggagaaaaagttgaactgggcttcggaaaagtagtacaagtatttacagaggaacaataccttgatttcgtaaaagaacattacagcaaaaaccgatctaaacataacaaactacttttagaagaaataccggaaaaaatgatagaaagacaattaaatgacacaagatacatatcaaaattcgtatcctctatactaagtaacatagttagatcagaaaaggacgacgacggcctcaatagtaagaatatactccctggcaacggcaaaatcacgacggaactgaaacgcgactggggactgaacgacgtatggaatgacttaatcttgccacgattcgaacgaatgaatactataactaattctgacctatttaccacttacaatgataaataccaaaaacaccttccaactgtaccgttcgaatatagtaaaggcttccaaaagaagcgaatagaccacagacaccacgccatggatgccttagtaatagcatgtgctacaagggaccatttaaatctaatgaataaccaaagcgcaaaatcggaactgaaacgatacgacctacaaaataaattaagaaaaaaagaaccatactttaatcaaaaagaaaacaaacaaaaagaagcctttaaagactttattaaaccttggggtacatttaccgaagacagtaaaaacgctctagaaaagataataatatcatttaagcaaaacttacgggtaatcaataaagcaactaattcatatgaaagctacaaagatgaagatggaaatttgcgcattggaaaagatggaaaacctgaaaaaggactcataaaacaaaagggactgaactgggccataagaaagccattacacaaggatacagtgtctgggcaaattaatctatcaagaattaaattacccaacggcaagatactaacagcgactaggaaaaacttggacacatctttcgatctaaaaaccatagaaaattctataactgacacagggatacaaaaaatacttaaaaattacctcctaagcaaagaaagccctgaacttgcattctccccagaaggacttgaagaaatgaataacgaaattgaaaaatataacaacggcaaatttcaccacccaataaacaaagcacgaatatacgaattaggaagtaaattcaacgtaggtcaaacgggaaatagaagagataaatttgtagaagccgccaaagggactaacttattctttgctatatatcaggacgaaaacaagaatcgatcatacgaaactatcccactaaatgaagttatagaacaccaaaaatggcgcgcttcactccccaaagaagaacaagaaaaaataccactcgtcccagtaaacaaactaaaaggtaccttcatcttttcattaagtccaaacgaccttgtatacgtaccaagcaacgacgagctagaaagatccgcaagcatagacttttctaagctcaagaaagaacaaatcaaccgactttacaaaatggtatcatcatcgggatcgcagtgtttctttgtaaaaagcgaagtagcaaccagcgtagtaaacaaaatggagtactcatccctaaacaaaatggaaaaatcgatagataacctgatggtaaaggaaatatgcataaaattaaaaatagatcgtctaggcaacatatcaaaagcctga

SEQ ID NO: 9185 - RNA, 4377 nt, synthetic construct
  misc_feature 1..4377: note = Cas9 variant
  source 1..4377: mol_type = other RNA
atgaagaaaatactcggacttgatttaggcacaaacagcattggttgggcattgatagaacaagatttcgaatcaaaagcgggaaaaatatccggagcaggtagtagaataatcccaatgagtcaagatatattagggacattcgaaactggccaatcctattcccaaactgccgacagaacacattatcgatccatacgaagattgtatcaaagaacaaaattgcgtcgagaacgtttacatagatcactaaatgtactaggattcctaccagaacattataaaaatgaaatagacttcgaacaacgcaaagggcaattttatccaaacaaagaaccaaaaatagcatattacccagaacaagtggcatcaaaagttaaatatcaattcttattcaaatcgtctttcctagaaatggtagaagacttcaaaagacgaggatacaacggtgccataccttatgactggacaatctattatctaaggaaaaaggctttagagaagaaaatagaaaaagaagaacttgcatggcttcttcttaatttcaaccagaaaagaggatactaccaactccggggtgaagaagaagacacaaatagtaacaagaaagaagaattttacgaactaaaagtgagttcagtcgaacaaactcacgacacatcaccatcagggacatggtacaatgtccatttgcaaaacggctgggtttacagacgcaaatcaaaagactcacttaaagactgggaaggattaaacaagaaatttatcgttacaacacatttgaatgctgatggctcggaaaaacttgataaagatggaaacgtgtcccgtagctttagagcacctaaagaagatgattggggtctagtcaagaaacgaacagaaagcgtactcgagaaaagtgggttacatgtaggagaatttatctatgaatcacttctagaaaaccctgaacagaaaatccgaggaagcctcataaaaacaatagaacgaaaatattataagaaagaacttgaagccatactagacaaacaaacctctttccaccgagaactgagaaatgacgcattatataaagaagcgactctagaattatatcccaaaaacagcgcccacagaagcaatatcaaacaaagaggtttcaaatatctatttatagaagatattatcttctatcaacgacctctcaaaagccaaaaacacttaattgcccactgccaatatgaaaaacgaacctacaaaaacaacggcggagaaactatagaagtcagtctacaaggagcaccaaaatcacaccccagcttccaagagttcagaatttggcaattcatctccaatcttcgattttatgacaaagaagaaatagttgaaggacaagaagtatctattacagaaaaactccttaaaagcgattccgatttcgccgaattataccattggctaagccatcaaagagaagtagaccaaaataaaacacttaaatatttcacccaaaagaaactaatacctaaacaaaagaaagataaccccactatcagatggaatttccccgaagacaagaaatatgaaatgggagagttcaaagcacaactattgagcagattagaaaaagtaagaaattgtcaaccagataaattcctaactcagaaaaacgaattagacctatggcatatcatttattctgtgaccgataaaactgagttcgaaaaagcactcgtaacatttgcagagaaaagagaactagacagtgaatccttcgtagaaaactttaagaaatttccacctttcaaaaatgactacgctagctactcactaaaagcgattaagaaaatactccccttaatgagacgaggcaaatattggaaagccgaaaacttgggaccccaaactctacagcggatagagaaaatagtaaacggtgaagcagacgacaaaatctctatacgcgcgagaaaattggcacttcacctaaatgatactaaatctttccaaggtctgccaacaagccttgcatgttacgtagcatataatcggcatagcgaaaatgaagaaaatcaaaaatggcaaacaccatctgacatagacaaatacctaaaagacttcaaacaacattcactccggaacccgatagtagaacaacttataacagaggctttacgcgtagttagagacatatggaaacattacggacaggggcagaaagacttctttgacgaaatacacgtcgaactcggaagagaaatgaaaaacccagcaataaaaagaaagaaactaagccagaaaatacaagaaaacgaaaacacaaattacagaatcaaagaggttttacgaaatttaaaagaaaacaacatagatgcgaaaccatactctccaagtcatcaagaaatacttaaaatatatgaagaaggtgtctaccaatccatagaaaacgtagaagacgaaatagagaaaattaggaaaaataatactccatcatccaaagacattaatcgataccggttgtggttggaacaaggttacattagtccctatacaggagaagtcataccactatcacaactattctctaatcaatatgaaatagaacatataatccctagaagtagatttttcgacgactcactcgcaaacaaagttatatgcgaaagctctgtaaatgcattaaaagacaataaaactgcactagagttcataacaaatcacggaaacgaaaaagttgagttcgccggtaaaactgtagaaatcttatcatctgacaaatacaccgaacattgcaaaagatatttcaaacgaaatagaacgaaactcaaaaatttactatcatatgacgtcccagaaggattcataaataggcagttgaacgactctaggtttatatcaaaatacgtgcgaaacttacttagcaacatagtccgagaagaagaagaaagagaagctatctctaaacatattttaaccatccctggatccataacctcacaattaaaacaagactgggggttaaatgaaaaatggaacgaagtagtaactcatcgcttcgaaagactcaataacctaactgggacaacggattttggcttctgggataataaaataaatgcatttagaataactgttccaaaagaattaagcaaaggatttaacaagaaaagaattgaccacagacaccatactctagacgcattagttatcgcggcatgcaccaaagaccacgtaaactatataactagcctaaacactgaacgtaataaccactctctagtctcaaaattacgaaacaccaagaaagttctaattaatgggaaagaacgccgaatagctaaagcatacaaattaccctggtcctcctttccccttgatgcgaaacaccaattagaaactactgtaatttcttttaaacaaaatctaagggtcataaataaaagtagtaacaaaacatggcaatggagaaatgtaaacggcgaacagaaaaagaaactaataccacaaacaaaaggagattcatgggcaatacgaaagtcaatgcacaaagctacagtatctgctaaagtcgaatcagtaggaaaagggaaaataaaaactacaaaccggacacccctaggcgagataaaaggcgagaaacacgtagagaaaatttatgacgcccgtatacgggaagttataatcccaaatcatttaaataaatacctcgatgaaaaaggcaaaccaaattacgaagcggcatttagccaaagtggaataaaacaactcaatgaaaacatcgaagtccttaatgaaggtaaaccacacgctcctatatataaagtaccattatttgaagtcggatcaaaatttcccgttagcgaagatgccaagagtcctaagaatcaaaaatacgttgaagcggacaaaggtacaaacttattcttcgctgtctattggaacgaagaaaaacagaaaagaaattttgaaacagtacccttacaccaagtaatagtacaccaaaaacaagtcgccagccttcccacagaacaacgaacaagcgttccaataaaaccagaactaggattgtttctattcagcctcagccccaatgacctagtttatgtcccaaccgaagaagaaatagaaaatccacatctagttgaccttaaaaacctttcaaaggaccaaacaaacagaatctataaaatggtatcgagtacgggcaacgaatgtcattttatacctcaccacatatcaagactcataatgaagtataacgcaaaacaaaaagtaggcgagttcggatcactaaacaaagcagaaaaagctataaccggagagacaatcaaagaaaagtgcctgaaaatacaaataaatagtctagggaaactcaaaaccgaaagaatagcttga

SEQ ID NO: 9186 - RNA, 4380 nt, synthetic construct
  misc_feature 1..4380: note = Cas9 variant
  source 1..4380: mol_type = other RNA
atgaaattcaacctaggattagatataggaacaaattccatcggatgggcattagttaacgaagattacgaaaacaagaaaggtaaaataatagcagctggttcacgaatcatccccatgactcaggatatcctagataaattcggatcaggcgctattacggaaacacagacagccctaagaactgactatagatcaaaacgaaaacttatacagcgttttctactacgtagagaaagattacatagagtacttaacgtattagacttcctacctaaacactacgccgaatcaatcgactttgaaaaatacttcggaaaatttctaccaaatacagaacccaaactggcttataaccaaaatcaattcatctttcaaaattcattcctagaaatgctcaaagaatttcaagaaaaacatcccgaacttctaaccaacaacaagaaaataccatacgattggacaatatattacctacgtaagaaagcgttaaatcaacgcatagaaaaagaagaattggcatggctccttttacaattcaatcaaaaacgaggttataaccaattaagagatgaagaagaagaatccgttcccaataaacaagtagaattttatagcctcaaaataattgacgtagtagcagaccaaccaaaagaaggcagagataaaaggtggtattcaataaaccttgaaaatggttggacctaccgcagagaatccaaaacaccactattcaattgggaaggaaaaacaaaagacttcatagtaactaccgatttaaatcaagacggatctatcaagaaagataaagaaggaaaagagaaaagatcatttagagcaccatccgaaggggattggacactattgaaaaagaaaacagaaaaagaaatatacgaatcaggaaaaacgctaggaacttatatatacgatgcactactaaacactccagatctaaaaattaaaggggattttataaggacgatagaccgaagtatctataaagaagaactacaacaaataatcaataaacaaaaagaatatcacctagaactaaacagctcaaaactatacaaagcatgtctagaagaactataccccaaaaacgaaatatacaaaagcgcccttaaaaacaaagatatagcatatctatttataaacgatatactatactaccaacgtcccctaaaagcacccaaatacaacataggaaaatgtacatacgagtcaagaacattcaagaaagaagataagaaaatacgcgaatatatcccagcagtcgccaaaagtcatccactcttccaagagttcagactatggcaatggattaaaaatttaaaaatatacgaaaaattaagctctgataactgtaccgactttttccttacgaacgaacaagatttcgaaaatctcttcgagttcctatggaacaagaaagaaatagaccacaaaggcattctagagtacttagttaaaactaaattccccgacctaaaaccaaaacaagtaaaaacaaaagtaaaagaatatcgctggaattacgtatacgaccatgagaaagacgaatcaaaaacctatccatgtggagagacatattttcttctgaaaaacaaactagataaaatctacaatgcacaggatgatttcctagacaaagaacgcctatacaatctgtggcatataatatactctgtcacagacaagaaacaatatgagaaagcactagcaaaatttgccctcaaaaaccatctcgataccaaatctttcgtaaataccttcaaaagaataccacctttcaaaaatgactacgctatctatagtctcaaagccataaagaaactactacccctaatgagagtaggaaaatactggaattacgatgatatagatcctatcactaaacagaaaatacagtgtattatcaccggagaagaaaatgatacaataagcacattggttcgagagaaaacaaaccacttctccaacgaaaatgatttcaaaaatctaccactatggctggcaggatacattgtatacaattcacataacgaatcgtcagagatagaaaaatggaaaagtcctcaagacatcgatacattcctcaagaaattcaaacaacatgcactacgtaacccaatagtggaacaagttgttactgagacgttacgagtggtacgagatatatggtctaagaaaggacaaggcaagaaagacttcttcaatgaaatccatattgaacttggtaaagacctcaaaaatcccgtcgataaaagaagaaaactatcctcaaccaatacgaaaaacgaatcaactaatactagaattaaagccttactaattgaactattcacacaaggagtagaaaatgtaaaaccaaactcgccaaaacaccaagaaattctaaaaatttttgaagaaggagctctaaatagcggcatagaaatagaagaggacataattaaaatcagcaatacagatcaacccactaagaaacaattagagttatatatcctatggttagaacacaaatacaaaagtccttatacaggccagagcatccccctaagcaaactatttactccgaattatgagatagaacatataattcctagatctaaatattacgacgataacttaagcaataaagtaatttgtgaaacggaaatcaatcgactcaaaaacaaccagctaggctacgagttcatcaacaatcacgagattcgagaggtgaccctagaagaaggaaaaacaatcagactcttaagtcctgaacagtactggaatttcgtaactacctattatgccaaaaacaaagcaaaaagagaaaacctactgctaaaagaacttcccgtacaaatggttgaaaaacaactcaacgataccagatacgttagtaaatatgtcatgcaacttctttcgaaaattgtaagaaaagaagacggaacagataatggcatcaactcaacaaatatactaagcatatccggaaaaatgactcgagcactgaaaaatgattgggatctaaatgacgtatggaatgatcttctattatacagattcgaaagactaaatacaatcacgaaaaccaacttatttaccacatactcagaacagaagcagaaaagaatgccaatcgtaccagaccaatacgcaaaaggcttccacaagaaaagacttgatcacagacaccacgcactcgacgctatagtcattgcttgcataacaagaaaccacataaactatatgaacaaccaaaacattcaaggggaaaaattgaagaaaaatgcgattgaaaaagaaaactacagagaaatactacaaaaatcaagattagacataagagcgcaattatgtgaaaagaaatataacgacaacgaccctacaaaatacaactgggttttcatcaaaccctgggcagattttacagaaaatacaaaagacatacttgaatccataataccttccttcaaacagaacttacgtattataaataagaccgtcaactactacgaaaaatataacgagaatggcaagaaagtgaaagttcgccaaataaaaggagataattgggcgataagaaaaccgctacataaagagacaatttcaggaaaggtccacttaagttacaaaacccctgccaagggtaaaatattaacagcaacaagaaaagtactcgactcatccatggattttaaaagtatagagaaaataacagacacgggaatacagaaaatccttaaaaattacctcgaatacaagaaaagcccagaattagcgttcagccccgagggaatagaagaactaaatgccaccataactaaatacaacaacggattccaccataaacccatttataaagtacgaatatatgaagaaggagtcaaattccctctcggaaacaaaggaaacaagaaatccaaatatgtagaggcagaaaaaggtactaacctatttttcgcgatatacaaagaccaagaaaacaaccgatatttcgagacaataccattcaacgacgtcctcgaaactctcaagaaaggaatgtccgcagttcctgagaaaaatcaagaagaaaacacattggtattcgcactaagtccacaagatctagtattcgttcctacattagacgaaattgaaaatccagatatcgttgacttcaaaaacctaactaaagatcaaaccaacaggatatataaaatggtcagcagctctggaaaacaatgctttttcataaaagccgaagtagctaccagcatagtaaacaaaatggagttctcaacgtcaaataaaatggaaaactcaattgaaggtattcaaatcaaatccaactgctggaaattaaaactagatagacttggaacgataactagggtaatcaagtga

SEQ ID NO: 9187 - RNA, 4383 nt, synthetic construct
  misc_feature 1..4383: note = Cas9 variant
  source 1..4383: mol_type = other RNA
atgacaaaattcaacttaggtttggacattggcacaaactcaattgggtgggctctcgttaatgaagactgtgaaaataaaaaaggaaaaattctagccgccggatcacgcataatcccaatgacacaagacatcctagataaattcggatcaggagcagctacggaaacacaaacagcactacgcactgattatcgaagtaaacgaaaattaatacaacgatttctactacgtagagaacgcctacaccgtgtattaaacgtactcgactttttacctaaacattatgcagaaagcatagattttgaaaaatacctcggtaagtttctacccaatacagaacccaaactagtatacaaccaaaaccaatttatattccaaaactcatttttcgaaatgttgaaggaattccaagagaaacaccctgagctgttcctaaacaaccaaaaaataccctatgactggacaatttattatctgcgtaaaaaagcactatctcaaaaaatcgaaaaagaagaactagcatggctccttctacagttcaaccaaaaaagaggatacaatcaattacgagacgaggaagaggaaaacacaccagacaaactagtcgaattctactccctcaaaatcataaaagtcactgcagacgaagcaaaagaaggcatcaacaagagatggtatagtattaacctagagaatggttggatatatcgacgcgaaagcaaaaccccactctttaactgggaaggaaaaaccaaaaatttcatagtaacaacagaccttaatcaagatggctcaatcaagaaagacaaagagggaaaagaaaagagaagttttcgtgccccctccgaaggcgactggacattactaaaaaaaaaaacggagaaagaaatttacgagagtggaaagactctaggaacatatatctacgacgccttactaaataatcccgacctaaaaattaaaggcgccctaataaaaactatagatcgatccatatataaagaggaactacaacaaatcataaacaagcaaaaagaataccattcagaactaaataacagcaaactttacaaagcttgcttggaagaactttacccaaaaaatgaaatctataaaaacgaactcaaaaacaaagacatagcatatctattcataaacgacatattatactaccaaagaccattaaaagctcccaaatacaacatcgggaagtgttcatacgaatctagaacatttaaaaaagaggataaaaaaataacagaattcatccctgcagtagctaaatcccacccactattccaagaatttcgactatggcaatggataaaaaacctaaaaatttacgaaaaattaacaaacgacaattatacagatttctttttaacaaacgaacgagacattgaaaaactattcgacttcttatggaacaagaaagaaatagatcataaaggcatactagaatatctcatcaaaactaagttcccagacctaaaaccgaaacaggtaaaaagtaaagtcaaagaataccgttggaattatatctacgaccacgaaaaagacgaaagcaaaaactacccatgtggagagacatacttcctacttaaaaataaactcgataagattacttcaatacaagacgacttcctcaacaaaaaacgactagaaaatctttggcatataatctactcagtcaccgataagaagcagtatgaaaaagccttagcgaagtttgcactaaaaaaccaattagacacaaagtcattcgtaaacacctttaaacgaatacccgcattcaaaaacgactacgcaatctattcattaaaggcaatcaagaaattactaccgctaatgcgcgtaggtaaatactggaactatgatgacatcgaccctatcacaaagcaaaaaatccaatgcataataacaggagaagaaaacgacacaataagcacattagtccgagaaaagacaaaccatttctctaatgaaaatgactttaaaaacctatctctctggttggcgggatatatagtctacaattctcataatgagagttccgaaatcgaaaaatggaaaagcccccaagatatcgatacattcctaaagaaattcaaacaacatgcattgaggaatccaatagttgagcaggtagtaaccgaaacattaagggtcgtccgcgacatttggctaaaaaaaggacaaggtaaaaaggacttcttcaacgagatccacatcgaactaggtaaagatctaaaaaatccagtcgacaaaagacgcaaaatctcatcaactaattcaaaaaacgaaacgaccaatatacggataaaggccctacttaaagaactcttaaaagaaggaatagaaaacatcaaacctaactctccaaaacaacaagaaattttaaaaatatttgaggaaggaatattaaattctggaattgacatcgaggaagagataataaaaatctcacaaattgcacaacctacgaaaaaacaactccagtactacagaaactggttagaacagaaatacatctcaccatacacggggcaatttataccactttcaaaattattcacttcaaaatacgaaatcgaacacataatcccgcgctctaaatattatgacgactcactttcaaacaaagtaatatgcgaaacagaaataaatagactaaaaaacaatcaactcggctatgaattcataaataatcatgaaataagagaaataacacttgaagaaggaaaaacaatccgtctactctcaccaaaacaatatttagatttcgtaacaacttactacggaaaaaacaaagccaagcgagaaaatcttcttctaaaagaaatccctatccaaatgatagaaaaccaattaaacgacactagatatgtatcaaaatatgtcatgcaactcttatctaaaatcgtacgaaaagaagatggaacagataacggtacaaactcaatcaatatactatcagtttctggaaaaattacccgggtcctaaaaactgactggggtctgaacgacgtatggaacgacctactttgttatagattcgaacgactaaacaaaataacaaataccaacctcttcacaacatactcggaacaaaaacaaaaaataataccaatagtacccgatcaatacgccaaaggatttcacaagaaaaaactcgatcatagacaccatgctctcgatgcgatattaatagcatgtatcactcgaaatcatataaattacatgaacaatcaaaacatacaaggagagaaattaaaaaatttcaaaatagacaaacacaactatcacgaaatattccaaaagtcaagattagatatgagagcccaactttgtgaaaaaaaatataacgatcacgactcaacaaaatacacttgggtctttacaaagccctgggccgatttcacagaaaacatcaaggacaccctagaattcatcattccatcatttaaacaaaacttaagaataataaataaaaccgtaaattactatgaaaaatacaatgaaaatggaaaaaaagtaaaagtaagacaaacaaaaggggacaattgggccataaggaaacctctccacaaagaaactatttcaggaaaggtacacttattatataagactccagcaaaaggaaagatcttaactgcaacccgtaaagttcttgacagcagtatggattttaaatccatagaaaaaatcactgacacagggattcagaaaatattaaaaaattacctaaaatataaagaatcgcccgagttggccttctccccagaaggtatcgaagaattaaatattacaatagccaaatataacgatggattttatcacaaaccaatatataaagtcagaatttatgaagaaggcgtaaaattcccattaggaaaccgaggaaacaaaaaaaataaatatgtagaagcagaaaaaggcacaaacctttttttcgcgatttacaaagatcaagaaaacaaccgatacttcgaaactataccattcaatgacgtactagaaacactaaaaaaaggaatgtcagcagtaccagaaaaaaatcaagaaaaaaacacactagtattcgccctctcacctcaagacctagtgttcgtaccaactcttgacgaaatagaaaaccccgacatagtggactttagaaacctaacaaaagaccaaacaaacaggatatataagatggtatcaagttcaggcaaacaatgtttttttataaaagcagaagtagcaacctccatcgtaaacaaaatggaattcacaacatcaaacaaaatggaaaacagcatagaaggaatacaaatcaaatccaattgctggaaattaaaacttgacagattgggaaccataacaagagtaataaaatga

SEQ ID NO: 9188 - RNA, 4389 nt, synthetic construct
  misc_feature 1..4389: note = Cas9 variant
  source 1..4389: mol_type = other RNA
atgacgaaaaatattttagggctagatttaggaacgaactcaatcggatgggcgttaataaaacaaaattttgaaaataaacaaggggaaatattagggatgggaagtagaataatacctatgagtcaagatatactgggtgattttggcaagggaaactcagttagtcaaaccgcagaacgaacgaaatatagaagtgtgaggagattaagagaaaggtttttacttagacgggaaagactacaccgagtactaaacctgttaaactttttgccccaacattacgcttcccaaattgatttcgaaaaacggttcggtaaatttaaagtagaaactgaaccgaaactagcttggaaaaatatcgatggacaattctcattcctgttccaaacatcgttcaatgaaatgttagaagacttccgcgtaaacgggcaagatgtaaaaataccatatgattggacaatctactacctaagaaagaaagcactaagtaagaaaatagaaaaagaagaacttgcctggatattactaaactttaaccagaaaaggggatattatcagttacgcggagaagaagaagaagaaaatccaaacaaattagtagagttttactcactaaaagtcgtggatgtagtagcagatgaacctcaaaaaggaaaattcgatatatggtactcattaatactcgaaaatggatgggtatatagaagaagctcaaaaatacccttattcgactggaaagataaaacaagagatttcatagtcaccactgatttaaatgatgacggtagcataaagaaagataaagatggtaatgaaaaacgttcatttcgagcacctagcgaaaatgattggaccctggtaaagaagaaaacggaacaagaaattgaacaatccaggaaaacagttgggacttatatttacgaagcactattggataatccgaaacagaaaataaaaggcaaattagtaagaacaatcgaaagaaaattctacaaagaggaacttcgccaaatacttgaaaaacaaaaagaatttcaccaagaactacaatccgacgacctatacaatgactgtgtgcgcgagctataccggaacaacgaagctcatcaactaacgctttccaagaaagatttcgtacacttattgatggacgatctgatattctatcaacgacctctcagaagccaaaaatcatcagtatccaactgcacactagaatttcgtaaatacaaagatgaaaacggtgcagagcacactcaatatctaaaagctatacctaaaagcaatccatactaccaagaatttagattatggcaatggatatataacttaaacatatacagacgagaagatgaacaaaatcctataacaggagaatttttgtctacaactaaagaatttgaaaacttattcgaatttttaaacacaagaaaagaagtagaccaaaaagcacttctaaaacatttcaaattaaacgacaaaacacatcgatggaatttcgtagaagataagaaatacccatgtaatgaaacaaaaaccatgataagttcgcgattagaaaaagtagaaaacatatcagatgactttttaacaagggaaatagaacagaaaatatggcacataatttattccgtcaacgacaaaattgaatatgaaaaagcactaaaatcctttgctaagaaacaccacctagatgaatccagcttctttgaagcattcagaaaatttcccccttttaaatcagaatatggatcatttagtgaaaaagctgtaaagaaactattaccactcatgcggttaggaaaatactggaactacgcagacatagataaatcatcgaaagaacgaatacagaaaattatatccggagaatacgacgaaaatatcaaagatagagtaagagaaaagtcggttcacctgaccacagaaaatgattttcaaggtttacaactatggctagcacaatacattgtatatggccgacattctgaagccagcatgattggaaaatggaatagcgccgatgacctcgaggaatttctaaagaatttcaaacagcactcattaagaaatccaatagtagaacaagttatcacagaaacattaagggtggtaaaagatatatggttaaaatacggaaatggggcaaaagactttttcaatgaaatacacattgaacttggccgagagatgaaactaccagctaaagaaagagaagatttgacccggaaaatcacagaaaacgaaaacacaaatctaagaataaaagcattattagcagaaatgatgaatgattcgtccgtcgaaaacgtacgcccattctcccctatgcaacaagaaattctaaagatatatgaagatggagtattaaattctggaatcgagatagaggatgaatatttaaaaatttcaaaaacagcacaaccttccccaagtgatttaaaacgatacaaactatggctagaacaaaaatataaatcaccctataccgggcagataatacctttgaataaactcttcacaccagaatatgagatagaacacattataccgcaatctagatacttcgatgacagttttagtaataagataatatgcgaaagcgctgttaataaattaaaagataattacataggcttaggattcattaaacaatttggcgggactattatagaattaggctttgggaaatcagtaaaagtatttgaaactgaagaatacgaagattttgtaaagaaacattatgcaaacaacagaagcaaaagaaacaaattattattagaagacattcccgagaaaatgatcgaacgtcaaataaacgacacaaggcacatatctaagtacatttcaggcgtactatcaaatatagttagaatagatgatgatcaagcaaagaaaatcatagaagacgcagaaatattagcacgtaaagaaatagataaggacaaagcaaacgaaataagacggaaagccaaaagtctagcaacagatgacgggattaactccaaaaacatagtccccggcaacggcaaaataacaacacaacttaaacaagattggggattaaacgacgtgtggaatgacttaattttaccccgattcgaaagaatgaaccaactgactaactcaaaagacttcacagtatggaatgaaaaccatcaaaaatatttacctactgtaccaatagaattttccaaaggattctcaaagaaacgcatcgatcatcgacaccatgcattagatgctctagtaatagcatgtgccacgaaagaccacgtaaacttactaaacaatcaaagcgcaaaatccgacacaaaaagatatgacctgaaaaagaaactaatgaaatttgaaaaagtggtctaccaccacacacaaactggaaataaaatcgaaagagaaataccgaagcaattcctaaaaccatgggaaaatttcacattcgacgctaaatacaacttagaatctatcatagtgtcatttaaacaaaatctcagggtcatcaataaggcaaccaactattacgaaaaatatgtagaaaaggacggcactaaaaacaaaggacgtgtagaacaaacaggtactaactgggccataagaaaaccaatgcacaaagatacagtcagcggtaaagtaaacttgccctgggtaaaagtgcctaaaggcaagatcttgacagcaacaagaaaaatcctcgacacatctttcgacctcaagtctattggcagcatcactgatacaggaatacagaaaatacttcgaaattacctagaatttaaaggatcccctgaactagccttctcaccagaaggaatagaagacctcaacaaaaatattgaaaaatataatgacggtaaacctcatcaaccaataaataaagtgagggtcttcgaattgggttcaaaatttcaagtcggtcaaacagggaataagaaagacaaatacgtcgaagcagcaaaaggcacaaatctattcttcgctgtatacgaagacaaaaatggtaaaagaagctacgaaacaatcccccttaacgaagtaatcgaaagacaaaaacaaggcttatccgttgtagatctaaaaggaactaatgacttttacttgtgtccaaatgacttagtctatataccaagtgacgatgaattggaaaatatcaataacatcgatttcaaaaacatcgcgaaagaaaagaatgaaagaatatataaagtagtaagtttctccggatcacaaatattcttcgttagacaagatatagcgacatcaatagtaaacaaagcagaactatcaactttaaacaaaatggaacgagcgatggatgggtccatgatcaaagaatcttgcgtcaaattaaacgtagacagactaggaaacatatcaaaagcatga

SEQ ID NO: 9189 - RNA, 4401 nt, synthetic construct
  misc_feature 1..4401: note = Cas9 variant
  source 1..4401: mol_type = other RNA
atgacgaaaaacatcctaggcctggatcttggaacaaactcaatagggtgggcactaataaaacaagatttcgaaaataaacaaggagaaatattaggaatggggtcacgaattatacccatgtcccaagacgtgctaggtgaatttggaaaaggaaatagcgtatcacaaactgcagcccgaacagattaccgaggagtaagacgactaagaaaaagatttctcttacgtagggaaagactacatagggtgcttaacgttctaaacttcttacccgtccactatgcctcacaaatagactttgagaaaaggttcggaaaattcaaagaagatacggaacccaaactagcgtacaacaaagaaggatttatatttaaaaatagcttcgaagaaatggtcgcagattttaggaaacatcaaccacaattactagaaaacgataagaaaataccctacgattggacaatatattacttaagaaagaaagccttaagcaagaaaatagaaaaagaagaattggcctggatcctactaaacttcaaccagaaaaggggctactatcaattacgaggagaagaagaagaagaaaaccccaataagctagtagaattttacagtctaaaaattacagacgtactagcagatgaaccccaaaaaggtaaaagcgacatatggtactcactaatactagaaaacggctggatatacaggaggtccagcaaaacccccttgttcgactggaaagagaaaacaagagattttatagtaacaacggacctcaatgacgacggttctataaaaactgataaagatggcaatgagaaacgttcattccgagcacccagtgaaaacgactggactctggttaaaaagaaaacggaacaagaaatagataaatcccagaaaaccgtaggaacctatatatacgaaactcttctccaaaaccctaaacagaaaataaaaggcaaattagtatgtacaatagaaagaaaattttacaaagaagaactcaaacaaatcttggaaaaacaaaaagagtttcatcaagaattgcaaaatgatgacttgtattcagattgtgtccatgaattatatagaacaaatgaagctcatcaactaacactctccaagaaagaaattgtaaacctgttcatggaagatctaattttctaccaaagaccactacgatcacaaaagacctccataagcaactgtacactagagttccgtaaatataaagatgaaaatggagtagaacatacgcaatttctaaaagctataccaaaaagtaatccctattaccaagagtttcgaatatggcaatggatttttaatcttaacatttacaaaagggatgatgacagcaatgtcactaaagagtttctcaatacaacagaagattttgaaaatctatttgagttcctaaataaccgcaaagaagttgaacaaaaagccctcctaaaacatttcaaactaaacgaaaaattacataggtggaacttcgtagaagataagaaatacccatgtaatgaaactaaaacaatgatatcaaccagactagataaagtagaaaacatctcaaaagactttttcacacgcgaaatagaacagaaaatatggcacatcatatacagcgtaaacgataaaatagaatacgaaaaagccctcaaatcatttgcaattaaacacaacctggatgaaaactcattctttgaagcgtttaagaaatttccacccttcaaatcggagtacggaagtttctccgaaaaagctatcaagaaattactaccgctcatgcgactaggcaaatactggaatgaagatgaaatattaaaatactcagatgactactttaaaaatattgaatctctattaggagtactaaaacaaagagatgaaaatatatcggatgccgatagggaaaactataacaaaacaataaacaacaaactcagagcagaactcgaaaacttccaaaacgctgaaatagaatcttttcaagggttaaggttgcacatcgcacaatatatactgtatggaaaacattcagagggagataataagaaattcaactccgccgacgatttagaaaaatttctaaaagagttcaaacaacactcgctaagaaacccaatagtagagcaagtcataacagaaactctaagagttgtaaaagacatatggacaaaatacggaaatggggcaaaagactttttcgacgagatacatatagaattaggtagggacatgaagaaaaccagagacgaaagagccgatgcaacaaaaataataacagaaaacgaaaatacaaatctacgaatcaaagccctactcgccgagatgatgaatgacgtagaaatggaaaatgttcgaccttactcaccgatgcaacaagaaatacttaaaatttacgaagacggaatattaaaatcagatatagagatagaggatgatatactcaaaatctccaaaacagcccaaccttcatctagcgaccttaaacgctacaaactatggctagagcagaaatacaaatcaccgtacaccggccaaataataccattaaacaaattattcacaccagagtacgagatagaacacattatcccgcaaagccgatactttgacgatagcttttcaaataaaataatatgtgaatcagccgttaataaactcaaagacaattacataggattaggatttatcaaacaatttggcggtacaatcgtcgagtgtggattcggcaaaaatgtaaaagttttcgaagcagaagaatacgaagactttgtcaagaaacactacgctaacaacagaggtaaaagaaacaaattattactagaagagataccagagaaaatgatagaacgacaaatgaacgacacaagacacataagtaaatatatttccggagttttatcaaatatcgttagggttgaagacggaagcgatgaaggtgtaaattccaaaaacatagtaccaggtaacggaaaaataacaacacaattaaaacaagattggggactcaatgatgtatggaatgaactaattctcccaagatttgaaagaatgaaccaactaactaatagcacggattttacggcatggaacgaaaaccatcaaaaattcctaccgacagtaccaattgagttctccaaaggattcagcaagaaacgaattgatcatagacatcatgccctcgacgccttaatcatagcgtgcgctacaaaggaccatgtaaacttgctaaacaaccagtcagccaaaagcgatacgaaacgatatgacctgaaaaagaaacttatgaaatttgaaaaagtagtatacaaccatcctcaaactggagatagaatagaaagggaagtgcctaaacaattcttgaaaccctgggataacttcacattcgaagccaaaaataacctagacaaaatcattgtatcgtttaaacaaaacctaagggttataaacaaggccacaaattattacgaaaaattcgtggaaaaagatggagtaaaaacaaaggaacgcgtagaacaaaaaggaacaaattgggcaatcaggaaaagcctgcacgaggaaaccgtaagtggaaaaatagatttaccatgggttgaaactaacaacggcgaatttatcacagcaactcgaaaatccttagacgcaagtttcaatttagagaaaataaagaaaattaccgatactggcattcagaaaatattgaggaattatctaaaagcaaaagatgacaatgccgaactagccttctcaccagaaggaatcgaagacctcaacaaaaatatcgaaaaatataacgatggaaaaagccaccaaccaatcgtgcgcgttagagtatacgaaaaaggaaaaggtaggttcgcgctcggacagacaggaaacaacatcgacaaatacgtccaaggatcacctaatctctttttcgcaatatataaagatgaaaatggtaagaaatcatacgaaagtataagactagacatagtcatagaacgaatgaaacaaggattacaagcagtacccgaaacaaatccgaacggtatatcattatatcaaaatctgtccccgctagatcttgtatatatcccgacagaagacgaaatagaatcaccacacctcattgactttactatattgaataaaacaagattagaaagaatttacaatgttaacgatttcagtggctatacaatatacttctcacaaaattcattcgcgaaaaatatctacccaaaagaaatggatatgacgtggaacgaaaagaagcaaaaaccctcaggttcgttcgattcaaaaacagcaagttataataagaaaagtatcaaagatatatttatcaaactaaaaatagatagactaggaaatatatctaaagtttcaaatacactctga

SEQ ID NO: 9190 - RNA, 4401 nt, synthetic construct
  misc_feature 1..4401: note = Cas9 variant
  source 1..4401: mol_type = other RNA
atgaagaatattcttggattagacttaggaacaaattctataggatgggctttagttaaggaagactttgaaaacaaacaaggtgaaattctaggactaggtagccgaatcatacccatgagccaggacatactaggagagttcggaagaggtaacagtatatctcaaacagcagatagaactggttacagaggagtacgaagattgcgggaacgtcatttgcttagacgagaaagactacatagagtgctcaatatactagggtttcttccaaatcattacgcaaaggaaatagatttcaccaaacgactcgggaaatttataaaccacgccgaacctaaactatcatttgataaagagttcatattcaaagattcattcaacgaaatgctaaaagacttccaacaaaaccaacccggattcatcataaataaacatggagaagaggctttagtaccatacgattggaccatatactatctaagaaagaaagcactaactcagaaaattgacaaagaagaattagcatggatactacttaactttaaccagaaaagagggtactatcaactcaggggcgaagaagaagaagaaaacacaaataaattagttgaattttacagtctaaaaataattgatgttatagccgacaacgaagtgaataagaaaggggaagtctggtactctctacatttagaaaatggatggatctatagaagaagttcaaaaatcagtctagtcgattggaaagacaaagtacgtgacttcatagttacaacagacgtaaacgatgatggatctgaaaaattagacaaagatggagtcgtaaaacgcagtttcagagcaccttccgctgatgactggacactactaaagaagaaaacagagcaagacatagacaactccaacaaaacagtaggagcctacatctatgaaaacctattactaaatcctaaacagaaaatcaaaggaaaactcgtgcgaacgatagaacgaaaattttacaaagatgagttaaaacaaatacttgaaaaacaaaaagagttccatcaagaactacaaaacgaacaactactccaagattgtgttagagaactatataaatacaatgagcaacatcaacaaatgctagaatccaaagacttcgtccatttgttccttaatgacataatattttaccaaagaccattaagatctcaaaaatcgttaatatcaaattgcaccctagaaaagagagtaagcagagatggagtagtttttccaataaaagttatatcgaaatcaaatccatattaccaggaatttcgattattacaatggctccaaaacctagcaatttatcgcaaagacgatgacgttaatgtaacccaagaatttctaaactcaatagaaagttgggaaaacttacttcagtttttaaacgctaagaaagaaataaaacaagaacaactaataaaattcttactcgaacaaaaaggattgaaaggtaacagcttaaaaacagccatactaacatatagatggaactacgtaacagacaaagtatacccaatgaacgaaacacgctcactaatacaagataaactaaagaaagtggaaaacgtagcgacagattttctctcttttgacaatgaaatggctctttggcacataatatactcagttaacgataaaattgaatacgaaaaagcactagcaaaattcgcttctaaacacaacttagatgaaatatctttcgttgaaagtttcaagaaatttcccccatttaaaagtgattatgggagcttcagtgaaaaagcaataaagaaattactcccactcatgcgctttggaagcgtatggaataaaaataatattgtgccgagtgtattagatagaatagacaaaatacttactggagaatatgatgagaaaataaaaataagagttcgagaaaaagcagaacaattccaactcaaccaaattgaagacttccaaaacctgccactatggttagcccaatacgtcgtatacgaccgacattccgaagcagaaatcgctggaaaatggaacagcgtaaaagatctagaaaattatttaaaggagttcaaacaacattcattaagaaatccaatcgtagaacaaataatcacagaaactctaagagtcgtcaaggacatatggcagcaatatggaaacggagtacaaaacttctttgatgaaattcatatagaattaggcagagaaatgaaaaatactgcagacgaaagaaagcgcataacaaactcagtaacagaaaacgaaaatacaaaccttcgaataaaagcgcttctagtagaactaaaggaagacacaaacatagaaaacgtacgaccacactcgcccatgcaacaagaaatactaaaaatctacgaagaaggcgtattaaacgccgtagaaaacatagacgaggacatccttaagataagtaaaacagcccaaccttctaaatcagaattaatcaggtataaactatggttggaacaaaaataccaatccccgtatacaggcgagatgataccactgtccagactttttacgagtgactacgaaatcgagcatgtgataccacaatcacggtattttgacgattctttaagcaataaagttatatgtgaagcagccgtaaataaaagaaaggacaaccaattagggcttgagttcatcaaaaatcaccactccgagaaaatagaactgggaaatggacgaacagcccaagtacttgaagtagaggcttatgaatcatttgtaaagaaaaactacgacaaaaatagaggcaaaagaaacaaactcctattagaagatgtgccagagaaaatgatagaaagacaacttaacgatactcgctacatatcaaaattcgttacacacttattaagcaacatagtgcgtaaagacgaagtcaacagtaaagatgacggaataaactcgaaaaatatcatccccggtaacggaaaaattacgtcacaattgaaacaggattggggactcaatgacgtctggaatgaattaatactaccccgatttgaaagaatgaacaaccttactaactcgacagacttcacatcgaccaacacaaatggaaaaatcatcccaactgttcctttagaatattcaaagggttttagtaagaaaaggatcgatcatagacatcatgcattagacgctctagtaatagccttagcaactagagatcacgttaatttattaaataatgaatcagcgctccctaagaaagatcgaacaaaagaagaacaaaaatcctttagatttgatctacaagtaaacctacgaaataaagaaaaatactttaacgtaaaagaaggcagggaaaaagagaaatttaccacctttaagaaaccatggaatacgctcacacaagacacccgggacgcactggagaatatggtagtctccttcaaacaaaacctacgagtaataaacaaagcaactaactactacgagtcctatacagatgaaaacggtaatctaagattagataaatacggaaacccaaagaaagaacttataagtcaaaaagggaccaattgggcaataagaaaatctctccataaagagactgtgagtggacaaatacatctagacagagttaaagtaacgaaaggaaaaatagtaacggcaacaagaaaaagtttagatagctcattcaatgaaaaatctatagaaagtatcacagacacgggaatccagaaaattttaagaaactacctaaaagctaaagacaacaaacccgacgtagcattttcaccagaaggaatagaggaactgaacaaatctatatctgtatataacgagggtaaaaaccatcaaccaattataaaagtcagaatcttcgaacaaggaagtaaatttcctgtaggagaaacaggaaataaaattgcaaaattcgtagaagcggctaaaggaactaatctattcttcgggatataccaagacaaaacgggaaaaagaagttacgacacaattccattgaatttagtcatagaacgactgaaacaaggattgagcccagttcctgaaactaacgaaaaaggacaccaactcctattccatctatcaccgaacgatctagtatacgtccctacaatagacgataatgaacaactggacagtaaccgggtatataaatttactgatagtagtgacaccacctgtaattttataccaagtaatataagcgcgatcatattcaatattaattcaaaggaacaagagaaaaggggtataaactatcccattcaaaatgaactaggagtaggatccccacaatctaaaaatcaaaaatcattcgacggttttatgataaaagaagtatgcattaaactaaaagtagatcgtttaggtaacatatcaaaaacttga

SEQ ID NO: 9191 - RNA, 4416 nt, synthetic construct
  misc_feature 1..4416: note = Cas9 variant
  source 1..4416: mol_type = other RNA
atgtgcaaatatttttacatcaaaaacttcatcacatttgtactcagcaaatctataataccaatgaaacatatactaggcctcgatctaggatccaattcaataggatgggcattcgtccaacaggattttgagaacaaacaaggcaagataatagcgaccggatcaagaataatccctatggatcaaggaatacttggtgattttgagcgaggcaacaccgtatcccaaacagctgaaagaacaacgtaccgaagcacacggagactacgggaaagacatttactaagaagagaacgtctacacagagtcttacacatacttggattcctccccccacactatgacgcgcaaatagattttacaaaacgatacggtaaattcatagacaacgcagaacccaagatagcttataataatggtaatttcattttcatgaattcatttaatgaaatgatcgaagatttcaaaaaacatcagcctcaactattctacaaaaaatcaaatggtgaagaaagcaaaataccttacgactggaccatatattatttacgtaagaaagccctctcacaaaaaataacacaacaagaactcgcatggcttatactccattttaatcaaaaaagaggatactaccaactcagaggtgaagaagaaacagaaaatcccaacaaagaagttgccttccactctctaaaagtcgtcgatgtagaggccgaagctccaaataagaaaggcgaaatctggtatactataaggctagagaatgggtggatctatagacgaacctctaaaatccctcttgacgattggaaagggaaaacaagggactttatagtcacaacggatttaaacgacgacggaacaataaaagtagataaagaaggaaaagagaagagatcattcagagccccggacgaaaacgattggaatctattgaaaaaaaaaactgaacatgacatagacttctccggaaaaacagtaggggcttacatatacgatcacttactacaaaaccccaatcaaaaaattaaagggaaacttgtacggaccatagaacgtaaatattacaaagacgaacttaaagcaatactagcgaaacaaatagccttacagccagaactcttcacagaaacactgctagcagattgtataagagaattatacagaaaaaatgaaacccaacaacaaaacctcttatctaaagatttcctacaccttttcgtggaagatattatcttttatcagcgtcccttaagatcaaaaaaatctacaatcgcaaactgtacactagaaaagcgcagttacattgacaaagaaacaaatgaaagaaaagatgcaccaattaaagtatgtgcaaaatctaacccttattatcaggaattccgagtactccaatggctacagaacctacgaatatatgaaattgaaacggaccgtgaagtaaccgcagaattcattgaaacaccacaagactgtgaggcattatttaatttccttatgagccaaaaagagattgacaataaaggacttttaaaatatttcctgtttgcaaaaaatccacaaatcaaagataaagctgccaaatcagaactcaaaaaatggttaactacttacagatggaactatgtatacgacgcagctgataattcctcaaaaaaatatccaatgaatgaaacaggttacgaacttcagcgttatctccaaaaagtggaaggcttaccagctaattttctaacgttcgacataacctaccaattatggcatctactatattcagtaaaggacaaagtagaatttgagaaagctctaaaaaaatttgcaaaaaaaaaacagctagacaaaacatccttcgtagattcatttaaaaattttaaaccgtatccaaacgaatatggtagcttctcagaaaaagcaataaaaaaactccttcctctaatgcgattcggtaaccattgggattttaatcgaatcgacgtttcgacacaaaaaagaatagatgacctcattaacggtgtcgccaatgaagacattagaaccattatacgagagaaagccgagaaatatcaattaaactctgaaacctgcttccaagacttacccttatggttagcacaatacgtagtatataacagacatgcggaagcaacagatatcgaaaaatggacgagcgtatcagacttggaagcctatctagaagatttcaaacaacacagtctacgaaacccaatagtggaacaagtcgtaactgaaacattaagggtcgtaagagacatctggcaacaatatggaggcggacaagcaaacttctttgacgaaatacacatagagctaggccgagaattaaagaaaacagctgaagaacgcaaacaattaagtgataaaaaccaagaaaatgaaagtactaacttacgaattaaaaaattattagccgaactcaaagaagatgctagcatacaaaatgtacgtccatactcattagtacaacaagaactattaaaaatatacgaagaaggagtattctcagcaacagatgaagtagaagaagatattcagaagattagaaaaaaagctgaaccctcgaaagcagatctccagcgatataaactttggttagaacaaaaatacaaatcaccatacaccggagaggtaatctcattaactaaacttttcacagaagaatatgaaatagaacatattataccacaaagtaggtactatgacgactccctatcaaacaaagtcatctgtgaatcggctgttaacaaactcaaaaccaatcaattgggattagagtttattcaaaaccatcacggggaaaaagttcgcattacagccaacaaagaagtaactatatttactgaagaacaatataaagaattcgtcaaaaagcactacgcaaataactctgcgaaacaacaaaaactattattaaacgaaataccagaaaaaatggtagccagacaactaaacgacacacgatacatctctaagtatataagtgaaatattaagtaaaatagtaagatccgatgaaaaagatgagggagtaaactcaaaaaatattataccatgtactggtaaaataactaccgctctgaaacaagattggggactcaacgatgtatggaataaattaatattgccgagatttgaaagaatgaatcaactcacacaaacccaactttttacaagctacaatgacagactacaaaaaaacctcccaactgtcccaattgaatactcacaaggttttcagaaaaaacgcatcgatcacagacatcacgccatggatgcgctagtaatagcttgcgcaacaagagaacacataaattacatgaataaccaacatgcactagataagtcaaaagataaaaaggagaaacaacaatcaagaatcgacctccgtaccatcttatgtgaaaaaaagaataataactggcaattcaaaaaaccgtggtcgacttttacgcaagaagccaaggaagcactcgaacatatcgtagtcagctttaaacaaaatctccgtgtaatcaacaaggctacaaattattacgaaaaatgggaagaaaaaaacggtgtcttagtcaaaaagaaagtaaagcaagaaggaaccaattgggcaataagaaaaccactgcacaaagagacagtatccggtaaaatagtcttagaccgaaaaataggtaaagataaaatcctaacagcaacacgcaaagcagtcgacatcacattcaccgaaaaaatcataagttccataacagatacaggtatccaaaaaatcctactgaattaccttaaatacaagggatcaccagaagtagcattttcgacagagggactagaagaactaaacaaaaacatagctcaatataacaacggaaaaaagcaccaaccaatatacaaagtacggatatttgaagaaggttcaaaatttcccttaggcgaaactggagccaaagctacaaaatatgtagaagcagcaaaaggcacaaatcttttttttggggtgtatcaagggaagggaaaaaggacatatgccacaataccattgaacgaagtgatagagcgacaaaaacaaggattaccatcagtaccagaacgaaacgaaaaaggagaaccattattattttcactaagccctaacgacctcgtatacgtaccaatggaaggagagatagcggaaacaattgactttaacaacctctccaaagaacaaaaagaaagaatatataagacagtttcattcactggaaatcaatgcttcttcgtacaagaggcagtagctacaccaatagtcaacaaaatggaatactctccactaaacaaaatggaaagggacatattaggcaccatgattaaagaggtatgcataaaactcaaagtagatcgactaggaaatataacaaaagcttga

SEQ ID NO: 9192 - RNA, 4416 nt, synthetic construct
  misc_feature 1..4416: note = Cas9 variant
  source 1..4416: mol_type = other RNA
atgggatataaagcaccacgaaacgacaaaggcgaaatagactatggggtcggccttgatctaggaaatggatccgtaggatgggttgccatggacaaagattatcacctaataagagcaagaggacacgaattaataggggccagactatttgacccagctaattcagcggaaaatcgacgagaatcacgaactacacgtcgaagattaagcagacgacgttggagactacgaatgttagacagtttatttgcatcagaattagctaaaatagatcctaacttcttagcaagaagaaagtacagttgggtgcatccaaaagatgaacaaaaccacgagaattggtatgggagtataatattcggttctaaagaacaagataagcaattttataaggattatcccacaatatatcacctacgaaagaaattaacggaagatacggagagacatgatatacgggaaatatatgtagctatacatcacattgtaaaatacagaggacatttcctaagagaaggagaaataaacagcgagaatctatttgacccagaaggatttgtcgagttaattaaagacgttataaagttaaacaattcatacgatgaatcaacaccgattttcgaagcaagtcctgctgatgtttcagaagcactactaaatgaacatacatcaagatcgggaagaatagaagatactcttgacaagctagatttttcagtaagcagagttgataaacacgaactaaaaggtatgagggacgcggctaaagcagtcataggagcaatagtaggaaatacagcagacttcagcaaaatctttaacctagacaacctagataaagactctaaagacaacctaaaactaaaatttgccgactcgaatttcgatgaaaaatatggaggtgtagtaggaagcggactactagatgaaactcaaatagagctagttgaccggattcacgcagtttatgacgcagttgcattgaaaggaatcctaggagatgcacatacaatctcagaagctaaggtagaaagttatgaaaaacatcgaaagaattggaaattaatcaaagaagaactaagaacaaaagaaaacaaagacgaagttgatctctggtacggagatctatctggtcgtcaatacaaaaatccacctgacccagaaaaagggcccgacgaaggatcaaagaaagacagtccaatcagagacagtgaccaaaaacagaatctaatcaagaaagcgaatgattattttacggaactaattgacgattcacaattatcagaagaacagaaaaattgtctgaaaaatgacatcaataacggacaattattcccagtacaaagaagtagtgataatggggtaataccttaccaaatacacctaaatgaattgagaagaataatagaaaatcaaaaacaatactacccatttttagcagaaacattcatacgaaaaacagcagaaggcaaaagttatgaagagaacaaaatagtggcactattaaaattcagagtcccgtattatgttggaccattggttagtaaagaagatatggaagaacatagttctggaaatagtgcttatcactggatggccagaaacccaggtagaggagaagcaataacaccttggaactttgatgaagtagtagataaagatgaatctggtgcacgttttatcagtagactcacgggaacagacacttatttgcttggagaaccaacgctaccccaacattcattactctacgaggagtacatggtcctttcagaacttaacaatgtaaggttgaatgttagacaaggaaaccattggagcgataaaaatcgacaaaggttaagctacaaacagaaagagttcttaatagaaaacttatttaaagaacataaaacagtgactagaaaaagggcagaagattgtctaagttcgatgggatgcggagaagtccaattatttggattaagcgatgaaaagaaatttgccagttcactaagctcatatattaccttaaagaaaatcttagggaaagcattcgtggacgattcaggaaatagtgctatactagaaagaattatcgaagtccaaacagtgtttgaggacagggaaccactaacgcatcagctaagtctcatagatagcctaacagttgaacaaagaaaacaattggcgaaaatacattacactggatggggaaaactttcacgtaaacttcttacaagcaagaaaggcagctataaaattcacagtcagaatgaaattatgagaacacaacacagcatcattgacataatgcgcggagatagtctaaacctaatagagataattagggacaagaaaataggtatcggagaatggatagataatgagaatttagatagagaaactggagaaagtgacgtatcacgactggaaagcgtattcgaaggaatagtaatgtctcctcgggtaaaaagaggagtagtccaagcagtaagggtcattgacgatttggcaaaagcaataggaaatcctccacaaagaatttttatagaaatggctgatgaagtacaggcttctcaaagaacagtaagcagattatcacgtttgaaagcgctatacggatcgcccagtttacaaaaagaatttaatgacctaaaagatttgaggaaatcattgaatgaaacgaaagacgcagatctccaggaagaccgattatacctatattacatacaactaggaaaagacttatataccggtaaagagatctcaattgactctctgtcttcagcctacgatatcgaccatattgtaccccaagcccttacccaagatgactccattgacaatagagtcttagttagtcgaaaagagaatgccagaaaaacagatagctatctttacaccccggatctaatcaaaaacatgcgacctctatggggaaaactactggcagcaggattaatgtcacaaaagaaatacgatgcacttacaagggtagatgatttcaaagatcgagagaaacaacgcttcgtacaacgatccctagtagaaactagacaaataatgaaaaatgtatcaacaattttaagaacatattacggggaagataccaatgttgtaacactaaaaagttcaataacacatgatatgagaaaatacctaggttttccttacaaaaatagagacatcaacgactatcaccacgcgcaagatgcattgtgtatatcagcagctggtcaattcatgctaaataggcattttgtatcaggaggagaagttactgatggagccagtaacgcctataacatgtatttagcagaatatctacaagaatttagagacgccaaagcaagaggtgaaagaaaacgaagcaccgcttttggcttcgtggttggaagcatgagttctaaagatgacgaaaagaggaccgatcatcgaacgggtgagatagtttggtcagagactaatgcagaatacttgcgcaaagttatgaactataagaaaatgttgataacacaaaaagtgggggatgtcaaaacccgagctctttatgatgagactcgatacggccacaaagaaagctccgctaaaagcatcaaatttgataatttgcgtcgagacacttcactatatgggggatttagtggggccagcacagcttatatgatgttagtagaatacaagaaaaagaataaacttgtatccataaccgctcaggaggcctccctactagcagtcgcagaccagaaaaacgacacagttagcgtgatggatggaattttagcatcgcatggattaagcggggcaaaaatattattaccaaaaattgtaaccggacaattattagactactcagacgcgttagtaacacttcaatcagcatctgagttaaacacagcacgacaaatgtggctacctcgaaacgattataacgacatcgacatcattttaaagagtaaagatattgaagatgcagctcataaattagggtacgactcagacacagtgcacgttttaagacgaatccaaaaactattcgaagcggtatttagagtagctgagtcccaattcccattacatcaactatcaaaagaccaacaagaagagattctacgagatccccagaactatggtttcggatctgcagttaaattgttaggcggcctcttaaaggccttacatgcaaatgcagaaaatacgaatctagcagggctcgtaaaagtattgcacggggataaagaatatagtgatgacggtaaagcaaaagaatttaagaaattcggattttcaccaagatggagacgaatatcaaatcccactggttttacattatccgactcagatacttttatatatcagtcccccagcggcatatttgaacaaagagttacagtaaaagaactgaaggagaaagctgataaacaaaaatga

SEQ ID NO: 9193 - RNA, 4422 nt, synthetic construct
  misc_feature 1..4422: note = Cas9 variant
  source 1..4422: mol_type = other RNA
atgaaaaatatacttggactcgacctaggtactaacagcataggatgggcacttatcgaaaaagacacagaccaaaaaaatgggaacatactcggcacgggtagccgaataatacccatgagccaagatattaaagatgaattcggtaaaggcaacagcatatcccaaacagctgatagaacaaaattcagaagcgtaagaagactacgcgaacgccatttactaagaagagagcggcttcatcgcgttctcaatgtcctaggattccttccaaaacattatgcagatcaaatcgacttcaaaaaaagactcggaaaacttgtaaacgaaacagaaccaaaacttgtatatgacaataaaaatttcatattcaaaaagtcatttgaggcaatgttatcagatttcaaccaacaccaacctctgctattagcagacggtaaaaaggtacccttcgattggacaatatactacttaagaaaaaaagcactgacagaaaaaatcgaaaaagaggagctggcctggctaattctgaatttcaaccagaaacgaggatactatcaattacgtggagaggaagaagaagaaaacccaaacaaaatggtagcatttcattcactaaaaatagttgaagtaatagccgatgaatcgcaaaaaggtaaagcagagacctggtattccctcattttagaaaatggatggatttatagaagatcctcaaaaaccccactttatgattggaagggcaaacagcgagattttattgtcaccaccgatctaaacgacgacggaagtataaaaacagataaggaaggcttggaaaaacgatcctttagagcacctgttgaagatgactggacactagtcaaaaaaaaaactgaacaagaaataaatcgaagtcataagacagtaggcacatatatatacgaaaacctattacaagatccaaaacaaaaaataaaaggcaaattagtgaggaccatcgaaagggagttttacaaagacgaattaaaaatgattctaaaaaatcaacaaaaatttcacccggaactaaacgacgaacatctctatataaattgtgtccgcgagctatatagaaataatcaagctcatcaaacaatactgagtaaaaaagattttgtacatcttttcatagacgacattatcttttatcaaaggccactacggtcccaaaaatcatcaatatctaactgcacattagaatttagaaaatataaaaacgaaaacggaaccgaccaaacagattacctaaaagccattccaaaatcacacccactgtttcaagaattcaggctatggcaatggatttataacttgggcatttaccaaaaagaagatgatacaaatgtcacagacgaacttatcaaaaatattgacgggtatcaagacttatttgacttcctgaacaataaaaaagagattagacaagatatactaattaaatttctagttgaacaaacaggactcaaagggaagcccctgtcttcagtagtagcaaaatatcgatggaactttgtcgaagacaagatctacccatgcaatgaaacaggtacgcaaatacggaccaggctagcaaaagtggagaacacaccagaagatttcctaacagccgaaactgaaattaaactctggcatataatatacagtgtgaacgataaagctgattatgaaaaagcactcaaaacatttgcagaaaaacataatctagacactcactccttcgtagaaaacttcaaaaaatttcctccatttaaatcagagtacggctcattttcagaaaaagcaataaaaaaactgctacccctcataagacttggcaaatactggtcctgggaaaacattgataaaaaaactcaagagagaatagaaaaaatcttaacaggagaattcgatgaggcgattaagtcaagagttagagataaagcaatacatttgaccgaagaagaccatttccaaggcctgcagttgtggttagcatcctatgtggtatatggacgacactcagaagcggacaatttagataaatggcacaccgtggcagacttagaagactatttagctgagtttcgacaacactcacttagaaatccaattgtcgaacaagtaatcaccgaaacacttcgtgtcgtcaaagatatatggctccaatatggtcagggcgcaaaggattttttcagcgaaatacatattgaattagctcgggagatgaaaaacaccggtgatgaacgaaaaagattgacttccctcgtaaccgacaatgagaatacaaacctaaggataaaagtactactgtcagaactactgaacgatggaaacgtagaaaacgtccgcccgtattcacctatgcaacaagaagctttaaaaatctttgaagacggagtcctaaactcagatatagaaatcgaggacgatattctaaaaataagcaaaatggctcaaccgacaaatacagaactgaaaagatataaattatggctagaacagaaatatagaagcccatatactggacagataataccactgaaccgactatttactgcagattacgaaatagaacacattataccacaatcaagatttttcgacgactcgttttccaacaaaataatatgcgaaagcgccgtaaatcaattaaaagacaagcaattaggattagaattcatcaaaaatcatagtggaacaatagttaaactcgggatgggaaagactgcaaaaatattagatgtagaatcatataacgaatttgtcaaaggaaactatacaaaaaacattagcaaaagaaataaattaatgttagaagaaataccagacaaaatgatagaacgtcaactcaacgataccaggtatatctcaaaatttataatcagcgccctaagtaacatcgtaagaagtgaaagtaatgacgatggattcaactcaaaaaacgtacttccaggaaatggaaaaattacctctagacttaaacaagattggggtatgaacgacatttggaatgaactaatattaccgagatttgagcgcatgaataaaataacagacagcgcagtattcaccgcatggaatgaaaataaccagaaatttctcccaatagtgcccttggaattcagcaaaggattccaaaagaaacgaatcgaccaccggcatcatgctctggacgccctagtaatcgcagcatcaacgagagaacacataaatttactaaataacgaacacgcaaaatcagataaaagattcgacttaaacagaaagttaagaaaatttgaaaaggtagcttacaatgacccaaaaacaggaaaaagaatagaaaaagaggttccaacaatttttctcaaaccatgggaaactttcacagttgatgctaaaaatagtttagaatctataattgtatcattcaaacaaaatcttagagtgataaatcgagcaacaaattacagtgaatcttataatgacgaaaacggcgccctacgattaggcaaagacggaaaccccctaaaagaaaaaataaaacaatcgaaaggagattcttgggcaatccgtaaacccatgcacaaagattttgtctacggaaaggtacatttacaaaatgtaaagttacccaaggataaattcattactgcaatcagaaaatcactagatgtaaccttcgatctaaagcgaatagaaacaataactgataccggtatacaaaaaatcttaaaaaactacctgcattcaaaagaaaataaagttgaactagccttctcaccagaaggcattgaagatatgaatcaacacatagaaagatacaacgatggtaagaagcatcaacctattcacaaagtacgtgtattcgaaataggcagccgtttctccttaggcgaatctgggaacaaaaaaaccaaattcgtagaggcggcaaaaggaactaacttattttttgctgtttatcaagatgataataaaggaaaacgaaattacgaaacaatacctctcaacattgtaatagaacgacaaaaattaggcttacattctgtaccaacagaagatgcaaaaggagggaaactactatttcacctaagccccaatgacatggtatacgtcccaacaagcgaagaattagaagataatctcgcctcagtaaatataaaaagattaaatacagcacaacgaaaaagaatatataaagtagagaaagcgagcggagtagaatgctactttataagacaagacatcgcatacttgataaaaaattacgacgcaaaaactaaaatcggagaacttgaatcacaaaacaaattacaaacaaccatgacagacgatagactaaaaataacagacgtctgtgtaaaactgaacatagatagactaggaagtatcgcggaaacatttcttggaaatcaatacggtgcaagcaaaaaaacatga

SEQ ID NO: 9194 - RNA, 4422 nt, synthetic construct
  misc_feature 1..4422: note = Cas9 variant
  source 1..4422: mol_type = other RNA
atggccaaaatattaggattggatttgggcaccaactccataggctgggccgtagtagaacgagaaaacattgatttcagtttgatcgataaaggggtacggatattctcagaaggcgtcaaatctgaaaaaggaatagaaagctcccgggcggctgaaagaacaggttatagaagcgcacgaaaaataaaatatagacgtaaattacggaaatatgaaactctaaaagtgctctctctgaatcgaatgtgcccactatcaatagaagaagtagaagaatggaagaaaagtggattcaaagactacccccttaatccagaatttctgaaatggctttccactgacgaagaatcaaatgtaaacccctacttcttcagagaccgagctagtaaacataaagtaagcctctttgaactcggcagagcattctatcatattgcacaaagacgaggcttcctaagtaacaggctagaccaatcagcagaaggaatattagaagaacactgccctaaaattgaagcaatagttgaagaccttatctcaatcgatgaaataagcacgaacatcacagactactttttcgaaacaggaatcttagatagcaatgagaaaaatggttacgcgaaagatctagatgaaggtgataaaaagctagtatcattatacaaaagcctactagctatcctcaagaaaaacgaatccgattttgaaaactgcaaatcagaaataatcgaacgactaaacaagaaagacgtactagggaaagtaaaaggtaaaattaaagatatatcacaagccatgctcgatggtaattataaaacactaggacaatatttttactccctttatagtaaagagaaaataagaaaccaatacacaagcagggaagaacattatcttagcgaatttataactatatgtaaagttcaaggtatagaccaaattaatgaggaagagaaaataaacgaaaagaaattcgatggcttagccaaagatttgtataaagctatcttctttcaaaggcctctaaaatctcaaaaaggattaataggaaaatgctctttcgagaaaagtaaaagtagatgtgcaatatcccacccagattttgaagaatatagaatgtggacctacctaaatactataaaaatagggacgcaatcagacaagaaattacgatttcttacacaagacgaaaaattaaaattagttccaaaattttacaggaaaaacgattttaatttcgatgtacttgctaaagaattgattgaaaaaggaagctctttcggtttctataaatcatctaagaaaaacgatttcttttactggttcaattacaaaccaacagacactgtggcggcctgtcaagtcgccgcatcactcaaaaacgctataggagaagactggaaaaccaaatcattcaaataccaaacaatcaatagcaacaaagaacaagtaagccgaacagtcgattacaaagatctatggcatctacttacagtagcaaccagcgacgtatatctatacgaatttgcaatagataaacttgggctggacgagaaaaacgctaaagcattcagcaaaacgaaactcaagaaagacttcgcaagtctttcactctcagcaataaataaaattcttccatacttaaaagaaggacttctctattcgcatgcagtattcgtggccaatatagaaaacatagttgatgaaaatatatggaaagatgaaaaacagagagactacataaaaacccaaatatcggaaataatagaaaactacacattagaaaaatctcgttttgaaatcataaacggcttattaaaagaatataaaagcgaaaacgaggatggcaaaagagtctactatagcaaagaagccgaacagagcttcgaaaatgatctcaaaaagaaattagtactattttacaaaagtaacgaaatagaaaacaaagaacaacaagaaacaattttcaacgaactactacctatattcatacaacaactcaaagactacgaatttataaaaatacaacgtctcgaccaaaaagtattgatcttccttaaaggcaaaaacgagacaggacaaatattttgtacagaagaaaaaggaacagctgaagaaaaagagaagaaaatcaaaaatagactaaagaaattataccacccctcagacatagaaaaatttaaaaagaaaataatcaaagatgagttcggtaatgaaaagatagtgttaggatcaccattgaccccatctattaaaaatccgatggcaatgagggcactccatcaactcaggaaagttctgaacgcacttattttggaaggccaaattgatgagaaaacaatcatccacattgaaatggctagagaactaaatgacgcaaataaacgaaaaggtatacaagattaccaaaacgataacaagaaatttagagaagacgcaataaaagaaatcaagaaactatactttgaagattgcaagaaagaagtggaacccaccgaagacgatatacttaggtaccaactatggatggaacaaaatagatcagaaatatatgaagaagggaaaaatatttccatatgtgatataataggaagcaatccagcatacgatatcgaacatacaattcctagatctcgaagtcaagacaacagccaaatgaataaaacattgtgtagtcaacgctttaatcgcgaagtaaagaaacaatctatgccaatagaattaaataatcatttagaaattctaccaagaatagcacactggaaagaagaagcggataatcttaccagagaaattgaaataatatcacgcagtataaaagctgcagcgacaaaagaaataaaagacaagaaaatccgaagaaggcattacctaaccttaaaacgagactacttacaaggcaaatatgatcgtttcatatgggaagaaccaaaagtgggttttaaaaacagccaaataccggacacaggtataataacgaaatatgcacaagcatatctgaaatcctacttcaagaaagtagaatcagtaaaaggcggcatggtagcggaatttcgaaaaatatggggaatccaagaatcttttatagacgaaaacggaatgaaacactacaaagttaaagacagaagtaaacatactcaccatacgatagatgcaatcacaatagcatgtatgacaaaagaaaaatacgacgtattagcacacgcatggactctagaagatcaacagaacaagaaagaagcaagaagtatcatcgaagcatcaaaaccatggaaaaccttcaaagaagatttattaaaaatcgaagaagaaatcctcgtatcacattacacaccagataatgtcaagaaacaagcgaagaaaatagtaagggtacgaggtaagaaacaatttgtggcagaagttgaaagagacgtcaacggaaaagcggtacccaagaaagctgcatcaggaaaaacaatatacaaactagacggagaaggaaagaaattaccaagactacaacaaggggacaccatccgtggttcattacatcaagactcaatctacggggcaatcaaaaaccccttaaatacggatgaaataaaatacgtgatacgaaaagacttagaatcgataaaaggcagcgatgtggagtcaatcgtagatgaagtagtcaaagaaaagataaaggaagcaatagccaataaggtactcttactaagctcgaatgcccaacagaaaaacaaattagtaggaaccgtttggatgaacgaagagaaaaggatagccataaacaaagtaagaatatacgctaatagtgtcaagaacccgttacacatcaaagaacattcactactaagcaaatcaaaacacgttcacaaacagaaggtatacgggcagaatgacgaaaattacgcaatggctatttacgaattagacggaaaaagagacttcgaacttataaacatcttcaatctggcaaagttaataaaacaaggacaaggtttctatcccttacataagaagaaagagataaaagggaaaatagtattcgtacccatagagaaacgaaataagagggatgttgttctaaaacgaggccaacaggtggtattctacgacaaagaagtagaaaaccctaaagatataagcgaaatagtggatttcaaaggaagaatatatataattgaagggttgtcaatccaaagaatagttagaccatcaggaaaagttgatgaatatggagtaataatgttacgttatttcaaggaagcaagaaaagcagacgatatcaaacaggacaacttcaaaccagacggtgtatttaaactaggcgaaaataaacccacacgaaaaatgaaccataatcaatttacagcatttgtagaaggcatagacttcaaagtactgccttccggcaaattcgagaaaatatga

SEQ ID NO: 9195 - RNA, 4425 nt, synthetic construct
  misc_feature 1..4425: note = Cas9 variant
  source 1..4425: mol_type = other RNA
atgaaaaagatcctcggtttagacctcggtacaaattcgatagggtgggccctcatagaaagcgacttcgaaaaaaaacaaggaaagattaatggactcggcagcagaataataccaatgagccaagatatactaggtaaattcgattcaggggttagtatttctcaaactgcagaaaggaccagctatcgtggagtaaggcgcctaaaccagagaaatttactgagaagggaacggctacacagagtcctaaacattctagacttcctgcctaaacactatagcaatgcaatagacttcgaaaaaaaactaggacaattcaaagaaaatgtagaggaaaaactgaactacgccaaaaatcaaataggacgacatgaattcattttcatggactcatttaaagagatggtaaaggaattcaaacaaactcaaccacaactattctataaaagagaaaatggcatagaaactaagatcccgtatgactggacattatactaccttagaaaaaaagccttaagccaaaaaattaagaaagaagagttagcctggatcatcttaaacttcaaccaaaaaagaggttattatcaattgaggggagaagatgtcctggatgaaagtaaaatcgaagacttctatagtctcaaagttgtagaagtccaggaaacagaagataaaaatgccagaggaacatggtataatgtaatattagaaaacgactgggtttataaaagacaaagtaaagaatcattagacaactggatcggaaaaaacaaggaatttattgtaacaacaaataaagagaaagacggctccttaaaactagacaaagcaggtaatgtaaaacgaaactttagagcagtggatagtgagaaagattggatagcaatcaaaaaaaaaacagagcaggacgttgaaatttcaaaacacacagtcggccaatacatttacgaaacgctcctacaaaacgctaaacaaaaaattaaaggaaaactagtgaaaacaatcgaacgcaaattctataaagaggaatttatcaaaataataaaagaacagctcaaacaccatcccgaactgcaatcaaaaaccctatacgaaacttgtatacaagaattataccccagaaacgaagcgcatcaaaacaatataaagtcaaaaggattcgaatatttattcacggatgatataatcttttaccaacgtccgctaaagtcaaaaaagtcgaccataagtggttgtcaatatgaaacaaggctcttcaaaaaaaccgtactaaacaaagtaacaaacaaagagaatgaaatttggcaaaaagaaccactgaaagctatatcaaagtcacaccccttattccaagaattcagactatggcaatttctcaaaaatctcaaaatataccaaaaagaggatgtcaaaggaaacctaatcgaccacgatattacatcggatttattgaaaacagaagctgactgggtagaactctttgactttctaaacattaaaaaagagatcgaacaaaaacaaataatacaattttttataaacaacaaacaaatagaaaaaggtaaaaaaaataattacagatggaactatgtagaggataaaaaatacccatgcaacgaaacaaaatcgcaactaatttcacgactcaagaaagttaagaatctcgacttaaatcttttctttacctccgaaacagaactaaaattatggcatataatatacagcgtgaaagataaaatacaatacgaaaaagcaataaaaaatttcgcaattaaaaataacatagacatagatagctttgttgaaaatttcaaaagattccctccattcaaaaatgaatatgcagcctatagtgaaaaagctataaaacgattattacctcttatgcggatgggggaatactggaatgagagcgaaatcaaacaagaagtaaaagacagagcatacagtatcatagaacgccttaaaggaatagacttcaataaagataaaatcgatgagaaaattacagacgacgacataaaaaagcaactcctcaagagtttcatagattttaaagacaaaaacccactaaaaggcctgaatacgtaccaagcatgctatctagtctacaatcgacactccgaagttaacagtatagcctattggaagagtccagatgacattaataaatatttggaaggattcaaacaacatagtcttcgaaatccaatcgtagaacaagtggtaactgaaacacttagaaccgtacgagatatatggcaatactacggaaaaggcaaagcaagctttttcaatgaaatacatgtcgaattagggcgagaaatgaaaaacccagcttataaaagaaaagcatcaacaaaccgggtaactgaaaatgagaacactaaccaccgcatcaaagaaatcttaaaagaattgcaaaatgaaggtgttcaagaagttaaatcatattcacgcaatcaacaagaaatattaaaaatatatgaagaaggtatctaccaaagtatagacgtagtagatgatgccatagaaaaaataagaaagaattcttccccaacaaaggcagaaatcatcaaatacaaactatggttagaacaaggatatacatcgccgtacactggaaaaacaatccccatgtctaagttatttacaacagattaccaaattgaacacataataccccaatcattatatttcgacaatagcctcagtaacaaaattatctgcgagtcagaagtgaaccaactaaaggataatcaaaccgcatacgaatttatcaaaaaacatggaacagaaaaagtcagcttgggaaagaacaaaacggtcgaaatcttcacactagaacaatacgaaaaacactgtaaccaatacttcaaaaaaaacaaaaacaaactaaaaaaactattaagtgaagaaataccggaaggattcattaatagacaattgaacgacagcagatacataagcaaattcataaagggcctactaggcaatctggtaagggaggaagatgagcaagaagtcactacaaaacacatagtcccagtaactggagccataacaagcaaacttaaacaggactggggtttaaacgacaaatggaacgaactagtcgcttccagattccaacgactaaatacgatgacaaactcaaataatttcggatattgggacacaaaaatcaatgcgtttcgagtacaagtgccagacgaaatttcaaaaggcttctccaaaaaacgaatagaccatagacaccacgcattagacgctttagtaatagcatgttgcactcgcaaccacatcaattacttaaacgccttgaacgccgaaaaaaaaaactatggactaagagaccttctcctcataaaaaacgacaagaaccattacaccaaatttttcaaacatccttgggacggattcccagtcgaagcaaaaagcgtactcgaaaaaacaatcatctcatttaagcaaaatactcgagtaataaacaagacaaacaataaaacatggcagtgggctgaaaaagaagggcaattaaaaaaagtacttgtaaaacaaacgaaaggagacaactgggccatcagaaaacccatgcacaaagaaactgtatccggcaaattaaacatacctacaccaaaaggcaaaatagctactgcctctagagtctcactttcggaaataaaaacccgaaaacaattggataaaataacggacataagtattcaaaaaatcttggaaaggcatttgaacaactatttagacgataaaggaaaggaaaaatttgatctagcatttaacgcagacggagtagaggaactgaacaaaaatataaaagtattaaacaaaggaaaaaaccaccaacctatttataaagtaaggctatacgaaataggatcgcgattcaaagtaggaaacagcggaaacaagaaggataagtacgtcgaagcagcaaaaggaaccaacctattttttgcaatatacttgaatgagaaagacaaaaaacgcgtttacgaaacgatacccctaaacgaagtcatagaacaccaaaaacaggtatcaaaccttcctaaaaacgaaagaacgccagtacccgtcaatcatacaaaaggaaaattcctattcagtctatcaccaaatgacctcgtatatgtaccaacagacgaggaaattgataacccaagcctagtaaactttaacaacctcaacaaaaaacaagttgaaaaaatatacaaaacagtcagttgcagcacataccaatgttttttcgtgcacaacactatatcaaaacctatacaaaataaagtagaattctcggcactaaacaaaatggaaaaatccattgatggtataatgataaaggatagatgctggaaactcaaaatggacaggctaggaaacataatctcagtaatacgctga

SEQ ID NO: 9196 - RNA, 4443 nt, synthetic construct
  misc_feature 1..4443: note = Cas9 variant
  source 1..4443: mol_type = other RNA
atgaaaacaatactaggactagatcttggcacaaactccatcggctgggccaaagtttgtgtagacaacgatggaaattacctcagagatataaaactaggcagcagaattattcccatgagtcaagatacactcgggaattttgataaaggagtaactgattctccaacagctgcacgaacaggttttaggggagtacggagaatccgagaacgagctttacaacgaagagaacgtctacatcgagtattacatgtgatgaaatttcttcctccacattatgaaaacgccataggatggaacagagaagaagcaacgacatatggcaaatttctaaaccatggagagccaaaactggcatgggaaaaacaagaagacggcagcatgaggtttctatttatggatagttttcatgagatgatggctgacttcgccgaatcgcagccgggtttagtagccggaggtaaaaaaataccactagactggaccctatactacctgcggaaaaaggcccttacacaagctatccgaaaggaagaacttgcatggatactactaaacttcaaccaaaaacgaggctactaccaattgagaggcgaggaagacgaggaaaacccggcaaaaagagaagaatatcacgagttaaaagtggtatccgtcgaagcagccgaagaaggcaaaggcggtaacacttggtacaacgttacattagaaaatggatggatctatagacgccagtccaaagtggaattacacgattgggtgggaaaaacaagacaatttatcgttacaacggagtacgaaaaggacggcgtaacaattaaaaaagacaaaaacggagaagtaaaaagatcttttagagcaccaagcgaagatgactggggactgagaaaaaaaagaacggaaagcttattagaggattcaggtaaaacggttggagccttcatttacgaccacatcctatcagaaccaaccgataagatcagaggaaactttataagaacaatagaaagaaaatattacaaaaaagagcttgaagccatattacttgaacaaactaagcatcacaaagaacttaaagatcagaatacattaatcgcctgcataaaagaactttatcaatctaacaaacctcatcaagactctctcatgaagaaagatatgacatacttgctaataaccgatctcatattctatcaaagaccactaaagtcaaaaaaaagcctaatagcagactgcccgtatgaatactatgagtacacgatcaaagaaacaggagaaataaagagacaagggatcaaatgcatagctaaatcaaacccgtattatcaagaatttagactctggcaattcattataaacctcagactattcgatcgcacggatgataaggaggtaacatcagaatatctatcatcaatggaagactatacaaagctctttacatacttaaatgatagaaaagatataaatcaagaaacgttgttaaaagatttctttaaacaaaaaaaagtaaaaatgggaatggaaaaagaattcccaataagatggaattatattgaagataaagaaaagaaatatccatgcaacgaaacaagacacgaacttttagcagctctagacaaagccggaattgaccacagttggctagacgacaaagagagattctataggttatggcacctattatatagcgtagaaagtaaagaagaagctgaaggtgcacttagaaaattaaaagataacgacgactttgtcaacgcctttcttaaagtaaaaccatttaaaaaagactatggcgcctacagcgaaaaagctgttaaaaaactcttagcaattatgagaatggggggactgtggaatgaaacggacatatgcgaacaaacgagaaacagaatacaatccataataaaaggagaaatagacgagaaaataaaagaaaggatgggaagaacgttctgccaactatcagacttccaaggcctcccagaatggcttgcatgttatgtggtttatggcagacacagtgaagcaacagacatccaaagatggacaaaaccagaaaatttaatggcgtatataaacggatttaaacaacactcgctacgaaatccaatcgttgagcaatgcatacttgaaacattaagaactgttcatgacatatggaaagaagcaggacatatagatgaaatacacgtagaattaggtcgcagtatgaaaagtacagctgaccaacgagcccgaatgtcaaagtcaatattacaaaatgaaaacactaatctgaggattaagtcactattaatggaacttaaaaatgcaaaagaaattgaaaacgttaggccctacagtcccatgcaacaggaaatactaagaatctatgaagaaggcgccctacaagaattaaccaaggaagatgcacaatacccagagataagcaaaataagccagatggcgcaaccatcagcaaaagaactactaaaataccgattgtggctagaacagaagtattgtagtccatacacaggaaaaccaatatcactatctaaattattcaccagtgcctaccaaatagaacatataataccgcaatccaggtacttcgatgatagtttcacaaataaagtaatatgtgaaacagaggtaaaccaactaaagtcaaacatgctcggctacgaatttattaaaaagcattcgggagaaatcgtacactgtacaacaataggtgatgtcaagatattagatgcaaaagaatattataactttgtaaccgaacattacgcaaataatagaagaaaaaaagaaaaattgttattagaagatataccccaagaatttttgaacagacaaatgaatgattctcgatatatatcaaaaaaagtaatggcaatactaagcaatatagtacgagaagaggatgaacaagaaacgaactcaaaattcgtcgttagctgctcaggcggcataacggatagactaaaacaagactggggtttaaacgacgtctggaacagcatagtctacccaagatttgaaagattaaataagttgacccaaacagaagctttcgggcgatgggaaaacaaagaaggcaaacaagtgtttcagacaagtctccccctggaactgcaaaggggattctcaaaaaaaagaatcgaccatcgtcaccacgccatggatgcattggtcatagcgtgtgccagtcgaaatatcataaattatctaaataacgagtccgctaaaagccaagaacaacgcgaagatttgcgaaaaaaactctgtgataaaaatagaataataagaaaaccatgggaaacatttacacaggacgctagaacagcattagaagacgtagttgtatcatttaaaaattacgtacgggtcattaataaagcaaccaactactatgaaaaatacgacgaaagcggaaaaaaaggcatggccgaacaaaaaggtcaagacatgtgggcaataagaaaaccaatgcataaagaaactgttttcggacaagtcaacctacgtaggaaggtaacggtcaaattgaaagacgcactagaaaatattccagccatctgcgataaagctcttcgagattacgtgaatgatctaatagccaaaaaatttaatacaaaacaaatgttagcgcattttaaaagtataaattaccgacttaacatgaaaagcgtaaataaagtaggaatatgggtcttctcagatgaaaaagaacccatggtcgcaacaagaaaagctatagatatatcattcgatgccaaacggattgacacaataacagacaccggtatccagcaaatattgtgtaaatacctaaaatctaagggcaacgatccaaatgtcgcatttacaccagaaggaatcgctgaaatgaataaacacattatagactataacaacggaaaacaacatcaacctatactaaaagtcagagtatccgaacccaaaggagcaaagtatcaagtaggagaaaccggaaacaaaaccaaaaaatttgtagaagcacaaaaaggaactaacctatactttgcaatttacgaggataaagatggtaaccgaagttacaacacaataccactaaatgaggtcgccgaaaggctgaaacaaggtttaagcccagtaccagaaaaaaatgaaaaaggaatatcactaaaattttacttatcaccaaacgacctagtatatgtaccaacggaagaagaaaaactatcaaacgagtgcaaactctcaaaagaaaggatctataagatggtttctagtacatccaacgagtgtcacttcataccctatactaccgctaaaccgatttacgataaattcgaatacgaagcgaagaataaaatgggtcgagccctaactggcgaaatgataaaagcagtctgctggaagctagaagtagaccgattaggaaacatactaaagatcataaaatga

SEQ ID NO: 9197 - RNA, 4452 nt, synthetic construct
  misc_feature 1..4452: note = Cas9 variant
  source 1..4452: mol_type = other RNA
atgaaaaccatcctaggactcgaccttgggactaatagtataggttgggcaaaaatctcaatagacgacaacggaaattatttaagagatattcaaatgggatcaagaatcatacctatgagtcaagacgtgttaggtaacttcgactcaggagtaaccgaatcacaaacagccgtacgaacaggattcagaggcctcagacgaatacgagaaagaagtctactaaggagagagaggctccacagggtactccacgtcatgggattcttaccaccacactatgatagtgctattggttggaacaaagaagaaccaaccacatacggaaaattcctaaaccatggcgaacctaaattagcatgggaacgccaaggtgatggaagtatgagattcctattcatggattcatttcacaaaatgatggaagatttcgccccacatcaacccgctctcgttgcagatggccgaaaaatacctctagactggacattatactacttacgtaaaaaggctctgactcagcctattaaaaaggaggaactggcatggattctattaaatttcaatcagaaaagaggctattaccaactacgaggagaagaagaagaagaaaacccaacaaaaagagaagagtaccatgaacttaaagtagttagcgtagaagcagcggaagaagggaaaggaggtaatacatggtacaacgtgaaattagaaaatggatggatatacagaagaagcagtaaaataccgctggacgactgggtagggaaaacgcggccattcatagtcacaaccgagtatgaggctgatggaattacattaaagaaaaataaagaaggagaagttaaaagaagtttccgagctccaggcgaggatgattggggccttagaaagaaaagaactgaatcacaacttgaagcatcagggaaaacagtaggagcgtttatctacgaccatctgctcgcagaacctgccgacaaaatacggggcaacttcataagaactatcgagcgaaaatattacaaacaagaacttgcagatatactccgtgaacaatcaaaataccatgaagaactacaaagtaagaaaattcttgcagactgcgctgaagaactatatagaagtaatcagccacatcgagatagcttattaaagaaagatatggtatatctactattaacagatataatattttatcagagaccactcaaatcaaagaaatcacttatagctgactgcccttatgaatattatgaatacgtagacaaagaaacaggagaaatcaaacgccaaggaataaaatgtgtagcaaaaagtaacccatactatcaggaatttagactatggcaatttgtattaaatttaagactatacgacagaacagaagataaagaagtaacagcggagtacctaccttcaaaagaagattatgctcgattattcgtatacctgaacgaccggaaagagattaatcaggaaacactactcaaagatttctttaaattaaagaaagtaaaacagcgtagcgagaaagaatttccggtcagatggaattacatagaagataaagaaaagaaatacccatgtaacgaaacaagacatgagctattaatggctctagatagagccggtatagagagaagttggttagatgacacagccaggcaatgtcgattgtggcatttattgtatagtattgaagttaaagacgaagcagaaagagccctaagaaaacttaaagacgatgatgaatttgtcagcgcatttttaaaagtgaaaccgttcaagaaagattatggcgcttactcggaaaaagccgtaaagaaactgttagcagtaatgagaatgggaagtcattggtgtgaagacgatatttgtaaagaaacaaaagaacgtattgaacatatacttcaaggagatgtagaagagaaaataaaagaacggatgaaccacaccgcatactcactaggagaactttccgattttcaagcactaccagaatggctagcatgttatgtagtttatggtaggcatagcgaagcaacagatataaaacactggaaaacccctgaatcgttgatggcgtacataaatggattcaaacaacactccttaagaaatcccatagtagaacaatgtatactagaaacgttaagaaccgttcatgacatatggaaagaagccggccatatagatgaaattcatgtagaactagggagaagtatgaaaagtacttcagaccaaagagcacgcatgaccgaaaatatactcagaaacgaaaacacaaacttaaggataaaatccctactgatggaattaaagaacgatgcggatattaaagatgtcagaccatactcaccaatgcaacaagaaatcctaagaatttacgaagaaggtgcactccaagaattaacaaaagaagacaacgattatgaagaaatttttaaaatatctaaaatgccccaaccatcagcaaaagaactactgaaatataaactctggttagaacaaaaatatcggtccccgtatacaggtaaacctatcagtctaagtaaactgttcacttccgcgtaccaaatagaacatataattccacaaagccgatattttgacgattctttcaataataaagtaatttgcgaatctgaagtaaatgctctaaaaggaaacatgctaggttatgaatttattaaaaatcacggtggcgaaatagtacattgcacactacttggcgatgtgaaagttcaaaacgaaagtgaatataaagcgttcgtgactgaacattatgcaaataacaagtataagaaagagaaattactaatggaggatataccacaagattttctaaatcgacatttgaatgattcaagatacatcagtaaagtggtaaaaacactactgtcgaacattgtacgcaccgaagatgaaatggagacaacaagtaagtttgttgttagttgtaccggaggaataacagatagattaaagaaagattggggccttaacgacgtctggaactctatagtatatagccgtttcgaaagactaaatgaactcaccaaatccgacgcatttggtcgctgggaaaataaagaaggcaaaagggtattccaaacatccgtacctttagaactacaaagaggatttaataagaaaagaatagaccatagacaccatgcgatggatgccctagtaatagcttgcgcaagccgaaatataatcaattaccttaacaacgaatcagcaaacagcccgaagaaaagagaagacttacgacaacaactatgcgacaaaaacagaataatacgaaaaccgtgggaatcgttcacccaagatgcacgagcagcactagaggatgttgtagtatcatttaaaaattatgttagagtaattaataaagcaaccaattattacgaaaggtacgacgcagatgggaagaaaacgataactaaacagaaatcacgtgagatgtgggcagttagaaaacccatgcataaagaaactgtatttggacacgtaaatctaagaagaaaagctattgtaaaattaaaagatgcattagaaaatattccatcaatatgcaataaagaattaagagattacataaacggattagtcgagcgaaattttaacacaaaacagcttcacgcacacttcagatccacggattatcgctggaacaaacaaaatgttgataaagtggaagtatggaggttctcagatgaaaaagaacccctagtcgccaccaggaaaccattagacaccagtttcgatgctaaaaggatagacactattacagatactggcatccagaaaatactgttaaactacttggaggctaaaggaggcgatccactaatagcattcacgcctgagggcattgcggaaatgaatcaaaatatagcattatataacgatggtaaaatgcaccaaccaatactaaaagtaagaatatccgaaccaaaaggagctaaatatcaaataggtcaaacaggaaacaaagccgataaatttgtagaagcccaaaaaggtactaacctatacttcgcaatctatgaggacgaggacaggaatagaacatataatacaataccactaaatgaagtagcagagagactaaaacaaggactcccacccgttccggagaaaaacgaaaaagaagtacctttaaagttctacttaagtccaaacgacttagtatatgtcccaacagaagaagaaattctaatgaaagaatgtaaattaaataaaaacagaatttacaagatggtatcttctacgggcaatcaatgcttctttataccatttagagtagcagtaagcatcgtgaataaaatggaatatagcccgctgaacaaaatggaaaaagcaatttcttccgaaatgatcaaagctgtttgctggaaattagaggtcgacagattggggaatataataagagtggttaaatga

SEQ ID NO: 9198 - RNA, 4452 nt, synthetic construct
  misc_feature 1..4452: note = Cas9 variant
  source 1..4452: mol_type = other RNA
atgaaaactatactaggcctagacctaggaacaaactcaataggatgggcaaaagtctcattggatgataatggaaattatctacacgacatcaaactaggttgcagaataattccaatgagtcaagatgttttggacaatttcgggaaaggtgttacagtatcacaaacatcagttcgtacgggcttcagaggcgtacgccgcataagggaacgatcactacaaagacgagaaagattacatagggtattacatcgtcttggttttctaccacagcattatgacgccgcaataggatgggattcagactgcgctaaaacatatggaaaattcctcgacaacggggaacccaaactagcatgggaaagacaagaagatggatcgatgcgattcctatttatgaactcattttatgaaatgatagctgatttcacaagtcatcagcccgcattagtggctgacggaaagaaaattccactcgactggacattatattacttacgaaagaaagctctaacacaggcaatacgtaaagaagaacttgcttggatactactcagtttcaatcagaaaagaggctactaccaacttcgtggtgaagaagaagacgaaaacccaaccaaaagagaagaattttgcgaattaaaagtagtagctgtcgaagcagctgaaaaaggtaaaggagacgacatatggtataacgtccacttagaaaacggttgcatataccggcgatcaagcaaaatttccttagacgattgggtgggaaaaaccaaacaatttataataaccacagagtatgaaaaagatggagtaacacctaagaaagacaaagacggaaaagagaaaagatcatatagagcacccaaagaagatgattggggactcagaaagaaaagaacagaaacagacttagaagcatctggtaaaacagtaggcgctttcatatatgaacatctacttgcagagcccttcgataaaatacgaggaaatttcatacatacgattgaaagaaaatactatagagcggaattggaagcaatattaacagaacaaagaaaatatcatgaagaactaaggtcagagcaaatgctcgcagtttgtgccgaggaattatatagaagcaacttacctcatcaacaaagtcttttaaagaaagacatggtatacttattattaagcgacttaatattttatcagaggccactgaaatctaagaaatccctaatcgctgattgtccatacgaatattaccggtacgttgataaagaaactggagaaatcaagaaacaaggtataaaatgcattgcaaaatcaaatccttattatcaagagtttagactgtggcaattcgttcttaaccttagattattcgatagaatgacagacaaagaagtaacagcagattatttacctacgaaagaagactacgtaagattatttgattaccttaataatagaaaagagataaatcaagaaacacttcttaaagactttttcagattaaagaaagtcaaactcggtagggagaaagagttcgaaataagatggaattacatagaagataaagagaaaaagtatccgtgcaacgaaacgcgatatgaactacttgtagcattagacagagccggaattgatagaagttggatagacgaagacggtaggcaatacagactatggcatctactctattcgatagaagttaaagcagaagctgaaagcgccttgcgaaaactaaactccgacgatgcctttgtcagcagcttcctaaaggtaaaaccctttaagaaggattatggcgcgtatagtgaaaaagccgtgaagaaattactggccgtaatgaggatgggatcaatgtggtcagaagcaaatatctgtgaagaaacacaaaatagaataagaagtatcatacgcggtgacatcgaagagaaaatcaaagaaagaatgggacataccgccagatcctttaatcaaattgatgattttcaggctttaccagaatggctagcatgctatgtggtatacgggagacactcggaagtaacagacatacaacattgggaaacaccagagcaactccaatcatacatcaacggtttcaaacaacactccttaagaaaccctatcgtagagcaatgcatactagaaacacttagaactgttcacgatatatggaaagaggcaggacacatagatgagatacacgtggaattaggaagagatatgaaaagaacagctgatcaacgagcacggatgactaaaaacatccttaaaaacgaaaatacaaatttacgtatcaaatcactgctgatggaactaaagaaagacaccgacattaaagaagtaagaccatattcaccaatgcaacaagaaatactacgaatttacgaagaaggagcattactacaactaaaaagagacgatgaagcgttcgctgatataagcaaaataagtcaaatggcacagcccactgcaacagagttacgccgatataaactgtggcttgaccaaaaatatcgaagtccatacacaggaaaatttatcagcttatcaaaactatttacctctgcataccaaatagaacacgtgataccacaatcacgttatttcgatgattcatttagtaataaagtaatatgtgaagcagaagtgaacaggttaaaaagcaatatgctaggttatgagtttataaaggcccatggaggagagatagtccattgtacaatgcttggagatgtaaaaatactatcagaaagcgaatataaagcatttgtaaatgagcactatgtaaatcatagagcaaagaaagaaaaactactaatggaagatataccacaagaatttctgaatagacaaatgaatgacagcagatatatctcaaaagtagtaaaagcacttttatcaaacattgtcaggacagaggatgaaatggatgtaacatcaaaatttgtagtgccatgctcaggcggaataacagacagattgaagaaagactggggattaaatgacgtttggaatagcattgtctacccaagattcgaacgactaaaccgaatgaccgggactgaagcatttgggcattgggaaaataaagaaggaaaaagggtattccaaacctcagtaccaatagaattacaattaggattcagcaagaaaagaatagaccaccgacatcatgcgatggacgccctagtgatagcatgtgcatcaagaaacataatcaactatttaaataacgaaagcgcaaatagccaaaagaaacgagaggatttaagaagattactatgtgataaaaacagaattatacgcaagccatgggagtcatttacacaagatgcgagagtagccttacaagatatagtcgttagcttcaaaaactacgtccgaattatcaataaagcaacaaattactacgaacgatacgacgaacaaggtaagaaaaccacagccgaacaaaagagctccgaaatgtgggcaataagaaaacccatgcacaaagagacagtattcggacacgtaaatttaaaaagaaaaacaaccgtaaaattgaaaaatgctattgaaaatattccaaatatttgtaataaagaactaaaagcatacattaacgagcttgtagaaaaacatttcaatacaaaacaaatgttagcccactttaaaagcataaattataggtggaacagacaaaatgtagaaaaagtagaagtgtggcaatacagtgatgagaaagagagaatggctgcaacaagaaagccacttgacacaagttttgataagaaacgtatagaaacgataacagatacgggcattcagaaaatactactgaattacttggaagaaaaaggaggggatcctaatatagcgttcacgccggaaggaatagcagaaatgaacaaaaacattagtttgtttaacgatgggaaacttcaccaacctatactaaaggtacgtgtggcgaagacaatgggagcaaaatatcaagtgggacaaacaggaaacaaagcagccaaatatgtgggtgcccaagaaggaaccaatttatactttgccatctatgaaaatgaagagggtgaacgaagttataatgctgtaccgttaaatgaggtagcagaaagactaaaacaaggaatgtcacccgtgccagagaaaaacgaaaaggatgtgcccttgaaattttacctcagccctaacgacctcgtctacgtcccgacagaagaagataaattatcaaacgaatgcaagctagataacgaaagaatatataaaatggtgtcggccacagggaagaaatgtcatttcctaccatattcagtagcgaacattatatataataaagtggaatttgaaagtatgaataaaatgggtaaagcactatcaggagaaatgataaaagctgtatgctggaaactagaagttgataggcttggtactatccttagagttataaaatga

SEQ ID NO: 9199 - RNA, 4452 nt, synthetic construct
  misc_feature 1..4452: note = Cas9 variant
  source 1..4452: mol_type = other RNA
atgaaaacagaactggatctaaacaaggatagattatacaaacacgtattagggttagacctaggcgttacatcgataggcttcgcacacgtagtagaatctgaaaacagaaacgaatctgaaatcaaacaaataggagttagagttatacaactcgataatttcgataaagtggataaaagtggcaaaacttcagaaagtaaaaatccagcagtagactttgcagcaggtaaaggactcacaccaaatggttctagaactaaaaaaagaggagctagaagaaacctagacagatatcaagatcgacgagacaatttactagaggtccttacaaaatcaggattcataaactctgagacaaaaagaacagaagatggaaaacacactacccaccaaacatgggaaatccgcgcgaaagcagtctccgagaaagtagaaaaagaagagtttgcaagaatcttacttgcaataaacaaaaagagaggatataaatcatcacgaaaagcaaaaaacgaagacgagggacaagcagtagacggaatggcagtagcaaaacgcctatatgaggaaaacctcactcctggacaatacgcatacgaagtacttagtggaggcaaaaagagcataccggatttttaccgatccgatttacaagccgaattcgacaaaatttggaacttccagaagcaattttatccgaacattctcacggacgaattctatgaagaacttaaaggcaagggccaaagagccacatctgcagcattttggaaaatacaccaattcaatacagcggacataaaagatttagaagatgaattaaaaaacgaaagaacaattaaactgagcaaaagagaccaaaaaaagctacaagcctacaagtggagatcagaagctgtggttaagcaattagggaaagaggaagtcgcatacgtcctaactgaaatcaacaataatctaaacaacagctccgggtatctaggagccatttcagataggtcaaaagaactctacttcaataaacaaacggtcggacaattcctatacaaacaacttaaagagaatcctcatacaagattaaaaaaccaagtattctaccgtcaagattacttagatgaattcgaaacaatatgggaaatgcaagcacaatttcatcctgaattaacacaagagcttaaggaagaaatcagagacataatcatattctaccaaagaaaattaaaatctcagaaagggctaatctccttttgcgaactcgaaagtaaagaagtggtaataaacgacacaaaaaaaataataggactacgcgtggcaccaaaaagttcacctctattccaagaatttaaaatatggcaaaacctcaacaacgtactagtaagaaaaaaaggatcaagaaagcgcatggtcaaagcacaaaatcagcatagtctgtttgaagagcccaaagaaatattttccttagacttagcaagtaaagaaaaactatttgaagaactaaacttgaaaggaaacctgtcagccaaaaactgcttagacatactaggattaaactcaaacgaatgggaactgaattacacccaattagaaggcaacagaacaaataaaagcttatacgaagctttcttaaaaatactagacatagaaggatatgacgtcaaagacctactgaaagttaaatcctccaaagatgaagtagaactagacgatctaaaagtaccagcttcggagataaaaaatatggttcgcgaaatttttagtactaataaaatagataccgaaatcttagactttgacgcagaaattgacggaaaagcgttcgaaaaacaaagttcataccaactatggcacctactttactcctatgaaggagatgactcgcaatcaggaaacgaaaaactatatgaactgctagcaaagaagttcggatttaaacgagaacacgctcaaatactcgcgaatgtaagtctagtagacgactatggaaacttgagcagcaaagcaatgagaaaaatatacccgcacatcagagaaaataattacagtacggcatgcgaattagtaggatatagacattccaaacattctttaacaaaagacgaactaaaggaccgcgtacttgaagacagacttgaattactaaaaaaaaactcactaaggcaaccggtagtagaaaaaatcttgaatcagatgataaatgcagtaaacgcacttatagaaaaaaactcagaacgcgatgaaaatggaaacataacaaaatatttcaaatttgatgaaataagaatagaactagcccgagagctcaagaagaacgctgcagaaagagctgagatgacaactaatatcaacgctgccaaattagtacatgaaaaaatatttaaaatcctccaaaatgaattcggtatcaaaaatccaaccaggaacgacatcattaggtacagattgtatgaagagttaaagggtaatggatacaaagatctatactccaacacttatatacctcgagagatattattctcaaaccaaatagacatagatcatatcctaccacaatcgcgactttttgacgactcgttctcaaacaaagtcgtggtttttagaaaagataacctgaaaaaaggaaatcagaccgcaatagattacataggaagtgaagtaggagaagagggcctcaaaaacttcatagaaagggtggaatctttatatgaactaggaaaaaaaaataaggaagaaggaatttcaaaagctaaataccaaaagctattaaaatcagccagcgaaataggagacggattcatagagagagacctacgagaaagccaatatatagcaaaaaaagctaaagaattattatttaaagtgactcgctcagtcgtttcaacctcaggctcaattaccgatagactacgagaggattggggactaataaacgtaatgaaagaactgaatctccccaaatacaagtctctaggcttaacagaaatacaagaacgaaggaacggtcaccaagtagaagttatcaaagactggacaaaaagaaacgaccacagacaccatgccatggatgcattagctgtagcatttactaagcataaccacatacaatatttaaattatttaaacgcgcgtaaaaatgaatcccacaagcttcatgggaatatcatcgctatagagacgctagaaacagaagtaaaaattgatgacttggggaataagaaaagagtctttaaggaacccataccaaactttcgacaggtagctaaagaacacctggaaaatgtactaatatcacataaggccaagaataaagtggttacaaaaaacaaaaacaaaatatccggaaaagaaaaacttcaaataacgctgaccccgcgaggccaactccacaaagaaaccgtatacggaaaataccgcttctatcaaagtaaagatgagaaggtatcagccaaattcgatttagaaacaatcgaaaaggttgcaaacccatcgtataaagcagcgttacttcaaagactaaacgaaaacgaaaatgacccaaaaaaggcattcagcggaaagaacgcactctcaaaaaatcctatatatatatctatggagaatgacataaaagttccagacacagttaaactcgtttggttagaagaagattactcaataagaaaagacgtaactccagaaaacttcaaagacgaaaaatcaatcgaaaaaatactcgacgaaggtgtaaaaagaattctaaaaaatagattgaaagaatttggaggagacgcaaaagaagcattttctgatctggataaaaatcctatttggctcaacgaagaaaaaggcacaagcattaaacgagttagaattagcggagtaaaaaatgctgaaccacttcattacaaaaaggatcatttcggaaacgacatattagatggtaatggaaacaaaataccagccgactttgtatccacaggaaataatcatcacgtcgcaatctacaaagaaccagaattcgataaaaaaggacaacctgtactagacgaactgggaaatcaaaaatataacctccaagaaaaagtagtcagcttctttgaagcagtggaacgagttaaccaaggattacctatcatcgacaaaacatacaaccaacatttaggctggcaatttttctttactatgaaacaaaatgaaatgttcgtctttcccaatgaaaaaaccagatttaaccccatagaaatagatttgctagacccaaacaacaaaaagctgatatcactcaatttattcagagtacaaaagatagctaataaaaattacatgttccgtcaccacctagaaactaacgttgatgacaagaaagaaatgaaaaacatagcctttatacacatacaaagttgcaacttactcaaagaaattatcaaagtaagacttaatcacctaggtgatatagtatcagtaggtgaatattga

SEQ ID NO: 9200 - RNA, 4452 nt, synthetic construct
  misc_feature 1..4452: note = Cas9 variant
  source 1..4452: mol_type = other RNA
atgaaaacgatactaggacttgacttaggtacaaattcaataggctgggcgaaggtcagcgtagatgatcacggcaattatctacacgacattaaattaggatcgcggataattccaatgagtcaagatatattagggaatttcgataaaggagtcactgaatcacaaaccgcaataagaacaggattccggagcgttagaaggataagagaaagaagtctgctacgacgagaacgcctacaccgagtactacatgtaatgggatttttacctccacattatgatagcgcgataggatggaatagagaagaagcaagtacttatggaaaattcctaaatcatggagaacccaaattagcctgggagaggttggaagatggttcaatgagatttctattcatggattcatttcatgaaatgatggctaattttgcacgtcatcaacccgcattagtagcagatggaagaaaaatacccttagattggacattgtattacctcaggaaaaaggcattatcacaagcagtgggcaaagaagaactggcttggattctactgaattttaatcagaaacgaggttattgccaacttagaggagaagaagaggaagaaaccccgacaaagagagaagaatattatgagctaaaggtggtgtcagtagaagcagctgaagagggaaaaggaggaaatacatggtacagagtgcaattagaaaacggctggatatatagacgtccgtccaaaattgcactcgacgattgggtaggcaaaactaaacaatttattgtaacaacagaatatgaaaaagacgggacgaccctgaagaaagacaaagatggcgaagtgaaaagaagttttagagcccctggagaaaacgattgggggctgagaaagaaaagaaccgaaagtcaattagaagcaagtggaaaaacagtaggagcatttatatacgaccacctattagctgaacccgcagacaaaattagaggaaactttataagaacaatagaaagaaaatattacaaacaagaactagaagccatacttcgagagcaaacaaaacaccacgaagaattaagatctaaagaaatgttagcaaagtgtgctgaagaactctatcaaagcaatcaaccccacagaaaatcactactaaacaaggatatgacatacttattactaaccgaccttattttctatcaaagaccccttaaatctaagaaaagtcttattgcagaatgcccttacgaatattataaatacaaagacaaggaaaaaggaaagaagaaacggcaaggcattaaatgtgtcgctaaaagtaatccctactatcaagaatttcgactgtggcaatttatagtaaacctaagattattcgatagaacagacgataaggaagttacagcagaatatctacgaagtcgggaagattatgcaagactatttgcatacctaaatgaccgcaaagaaataaatcaagaaacattattaaaagatttcttcggtctaaagaaagtaaaaattggagctgaaaaagagttcgcaattagatggaactatatcgaagataaagaaaagaaatatccatgcaacgaaacacgacacgaacttttacttgctctagatagggctggaatggacagatcatggctagatgattctgaacttcaataccgattatggcatctcttatacagcgtagaagcaagagatgaagcagaaggagcattaaggaaactaagagatgatgatgagttcgtaggagcatttctcaaagtcaaaccatttaagaaagattacggagcttattctgaaaaagcagtaaagaaattattagctgtaatgagaatgggatcatggtggcatgaggaagatatttgtaaacaaacgagggatagaatcgaaagaattgtgcaaggagacatcgaagagaaaataagagaaagaatgggccacgccgcatattctttttctagattagcagatttccaaggactacccgaatggctagcctgttacgtagtatatggcagacacagtgaagctacacacatattacgatgggattcaccagacaaactattgtcatatataaaaggctttcgacaacattcactaagaaaccccattgtagaacaatgtatccttgaaactttaagaactgtacatgatatatggaaagaagcaggacacatcgacgaaattcacgtagaactgggaagatccatgaaatcaacagctgaacaaagagctcacatgacgaaaaatatattacgaaacgaaaatacaaatttacgaatcaaatgccttcttatggagcttaaaaatgatgcagatgtcaaagacgtaagaccatattctccgatgcaacaggaaatactgaggatttacgaagaaggagcccttcaacaactgaccaaagacgatgcggaatacgcagaaattagtaaaatatcgaaaatggcccaaccatccgctaaagaattattgagatataaactttggttggaacaaaaatataggtcaccatatacagggaaaccaataagcctatcaaaacttttcacatcagcctatcaaattgaacacgttattccacaaagccgctattttgatgactcttttaacaataaagtgatttgtgagagtgaagtaaatactcttaaaagtaatatgctaggctatgagttcatcaaaaatcactgcggcgaaatagtccattgcacaatgctgggggacgtaaaagtattcagcgaatcagaatataaagcattcgtcacagaacattactccaacaataaatataagaaagaaaaattactgctagaagacattccacaagaatttctaaacagacaaatgaatgattcacgctatatatccaaagtggtaaaaggtctcttaagtaatgtcgtcagaaccgaagacgagttagaagccacaagtaaatttgttgtgagttgcaccggtggaattacagaccgattaaagaaagactggggcctaaatgatgtatggaatagcatagtgtattctagatttgaacgcttaaatggactaaccaaaagcgaacatttcggacactgggaaaataaagaaggtaaacgggtatttcaaacttcagtaccaatggaacttcaacgagggttcaataagaaaaggatagatcatagacatcacgccatggacgcattagtaatagcctgcgcatctcgtaacataataaattatctaaacaatgagtttgcaaaatcaccgaaacagagagaagacctacgacaactattatgcgacaaaaatagaattattagaaaaccatgggaaacttttacacaggatgcccgagcagctctcgaggatgtcgtcgtatcattcaaaaactatgtaagagtgatcaacaaaacaacaaactattatgaaagatatgacgccgacggaaagaaaacaatggtcccacaaaaaggaaatgaaatgtgggcagtgagaaaaccaatgcatgaaggaacaatgtatggacgagtaaacttacgacgaaaagcagtcgtcaaactaaaagaagcattagaaaacataagtagtatatgtaataaagaattacgtgattatataaacgtattagtagaaaaacaatttaatacaaaacaactattagcacatttcaaaagcatggattacagatggaacaaacagcacatcgataaagtcgaggtatggagattctccgacgaaaaggttcaaatggttgcagccaggaaaccgttggatactagctttgacaaagagtgtatagcgagcataacagatactgggattcagaaaatattattaaactatctcgaatcgaaaggaggagaccctgcaatagcctttacatctgaaggaatagctgaaatgaaccaaaacatagcagtttacaacgatggaaagaaacatcaaccagttataaaagtacgaaaatcaacaaaattagggaaaaagttcgctgtgggacaaatcggctgcaaatcaaaacaatttgtcgttgctgaagccggaacaaacttatattttgcaatatacgaagatgaagaagggaaaagaagctatgacactattcctcttaacgaggtaacggaacgattgaaacaaggtctaagcccggttccagaaaagaatgagaaagaagttccattaaagttctatctaagcccaaatgatctagtatatgtaccgacagaagacgaaatgcaaatgaaagagtgtaaactcaataaggaacgaatatacaagatggtaagcagtacaggtaatgaatgtcacttcttaccatatagcgttgcgtcagtaatatacaacaaagtagagttcgaatcaatgaacaaaatgggccgggctttaactggggaaatgattaaggcagtgtgctggaaattggatgtagataggttaggaaatatactacgggtaatcaaatga

SEQ ID NO: 9201 - RNA, 4452 nt, synthetic construct
  misc_feature 1..4452: note = Cas9 variant
  source 1..4452: mol_type = other RNA
atgaaaaccatattgggattagacttaggaacgaactcaataggttgggccaaaataagtatagacgataacggcaattacttaagagatatacagctgggaagcagaataatacccatgagccaggatgtcttaggcaactttgataacggagtaacagagtcacagaccgccgtgcgtacaggatttaggggcttaagaagaataagggaacgaagcctccttcgcagagaaaggctacacagagtattacatgtaatgggctttctcccaccacactatgatagtgcaattggatggaataaagaagaaccaacgacatacggaaaattcctcaaccatggggaaccaaaactagcttgggaaagacaaggcgatggcagcatgaggttcttattcatggactcatttcataaaatgatggaagattttgcgccgcaccaaccagcattagtagcagacgggagaaaaattcccttggattggacactatattatctaagaaagaaagcactaactcagcccataaagaaagaagaactggcgtggattctgctaaattttaaccagaaaagagggtattaccaacttcgaggtgaagaagaagaagaaaatcctacaaaacgagaagaatatcatgaactaaaagtagtcggcgtagaagccgccgaagagggtaaaggaggaaacacatggtataacgtaaaactagaaaacggttggatctatcgacgctcaagcaaaattcctctagatgactgggtcggaaaaaccagaccatttatagtaacaacagaatacgaagcagacggtatcacactgaagaaaaataaagaaggcgaagtaaaaagaagttttagagctcccggagaagatgattggggcttatggaagaaaagaacagaaagtcaattagaagcctcaggaaaaactgtcggggcttttatctacgaccatctactagctgaaccagcagataaaatcagaggtaatttcattcgcactatcgaacgaaaatactacaaacaagaactagcagatatcttaagagaacaaagtaaataccatgaagaactacaaagtaagaaaatacttgctgattgtgcagaggaactatacaggagtaatcagcctcatagagattccctattgaagaaagatatggtctatctattattaaccgatctaatattttaccagaggccgctaaaaagcaagaaaagtttaatagccgattgtccatacgaatactacgaatatgtagacaaagaaactggagaaattaaaagacaaggtataaaatgtatagctaaaagtaatccatactaccaagaatttcgactatggcaattcgtcctaaatctgcgattatatgacagaacagaagataaagaagtcacagccgagtatcttccaagcaaagaagattacgctagactcttcgtatatctgaacgaccgcaaagaaataaatcaggaaacattactaaaagactttttcaaactaaagaaagtaaaacagagatcagaaaaagattttccagttaggtggaactacatagaagataaagaaaagaaatatccatgtaacgaaactagacatgaattgcttatggcactagacagagctggaatagaaagaagttggctagatgatacggcacgacaatatagactgtggcatttattatacagcatcgaagtaaaagacgaagcagaacgagcactgcggaaattaaaagacgatgatgaatttgtcagcgcatttctgaaagtcaaacctttcaagaaagattatggtgcatattccgaaaaagcggttaagaaactcctcgcggtaatgaggatgggatcgcactggtgcgaagatgacatttgtaaagaaactaaagagcggatagaacatattctgcaaggtgatgttggtgaaaagattaaagaaaggatgaatcacaccgcctatagtctgggtgaattatcagatttccaagcgctaccagaatggctagcgtgctacgtagtctatggaaggcatagtgaggcaacagatataaaacattggaaaacacctgaatcattaatggcatacataaatggatttaaacaacattctctacgaaacccaatagtggaacaatgcattttagagacgctcaggacagtccatgacatttggaaagaagcaggacatatagacgaaatacacgtggagctaggcagaagtatgaaaagcacatcagaccaaagagcacgaatgacagaaaacattttaagaaacgaaaatacaaatttgagaattaaatcactactcatggaacttaaaaatgatgctgacataaaagatgttagaccatactctccaatgcagcaagaaatattaagaatatacgaagaaggggcattacaagaactaacaaaagaagataacgactacgaggagatctttaaaatctcaaagatgccacaaccctcagctaaagaattactaaaatataaactttggctagaacaaaaatacagaagtccatatacaggaaaaccaatttcattaagtaaactttttacgtcggcatatcaaatagagcatattataccacaatcgaggtatttcgacgattcatttaataataaagtcatatgcgaatcagaagtaaatgccttaaaaggtaatatgctaggatatgaatttattaaaaaccacggaggagaaatcgtacactgtacacttctaggggacgtgaaagtacaaaatgaatccgagtacaaagcatttgtaaccgaacactatgcaaacaacaaatacaaaaaggagaaactattgatggaagatataccacaagacttcctaaatcgacacctgaacgactctcgatacatatcaaaagttgtcaaaacattattaagcaacatcgtaagaacggaagatgagatggaaactacatcaaaatttgtagtttcatgcaccggaggtattaccgatagattgaaaaaggattgggggttaaacgatgtctggaactcgattgtatactcacgattcgaaagattaaacgaattaacgaaatccgatgcttttggtcgatgggaaaataaggaaggaaaaagagtttttcaaactagcgtaccactagaattgcaaagagggtttaataagaaaagaatagatcatagacatcacgcaatggatgcactggtgatagcttgtgcatctagaaacataataaattatttaaataacgagagcgccaactcaccaaagaaacgagaagacttgagacaacaactctgtgataaaaacagaataataagaaaaccatgggaatccttcacacaggatgcaagagcagcattagaagatgttgtagtaagtttcaaaaactatgtacgagtcataaataaagcaactaattactacgaaagatatgatgcagacggcaagaaaaccataaccaaacagaaaagtagggaaatgtgggcggtcagaaaaccgatgcacaaagaaactgtattcgggcatgtaaatctaagacgaaaagcaatagtaaaactaaaagacgctttagaaaatatcccgagcatatgtaataaagaactaagagattatattaacggtctagtagaacgaaatttcaatactaaacaactacacgcccactttagatctaccgactatcgttggaataaacagaacgtagataaagtggaagtttggagattttcagatgagaaagagcctctagtagcgacaagaaaacctttagataccagtttcgatgcaaaaaggatagatactataacagataccggcatccagaaaatattactaaattatcttgaagcaaagggaggagatccgctaatcgcctttactccagaaggaatcgcggagatgaaccaaaacatcgcgctttataacgatggaaaaatgcatcaacctattctaaaagttcgaatatcagaaccgaaaggggccaaatatcaaataggtcagacgggtaacaaagcagataaatttgtggaagctcaaaagggcactaatttatacttcgctatttacgaagacgaagaccgaaatagaacatataacacaataccgctaaatgaagtagcagaacgactaaagcaaggcctaccaccagttccagagaaaaatgaaaaggaagtgccactaaaattttacctatcgcctaatgatttagtttatgtcccaactgaagaagaaatacttatgaaagaatgtaaactaaacaaaaaccgaatatataaaatggtatcatcaaccggaaatcaatgctttttcatacccttcagagtcgccgtgagtattgtaaataaaatggaatactcaccactgaataaaatggaaaaagcaatctcaagcgaaatgattaaagcagtctgctggaaattagaagtagatagactcggaaatataattagagtagtaaaatga

SEQ ID NO: 9202 - RNA, 4458 nt, synthetic construct
  misc_feature 1..4458: note = Cas9 variant
  source 1..4458: mol_type = other RNA
atgaaaaacatacttggcctggatcttggtacaaactctataggttgggcaaaaatatccatagacgataacggaaagtatataaaagacagcataaaactaggatcacgcataataccaatgtcacaggacgtactatcaaactttagtaaaggagtaaccctatctcaaacttcagaaagaacatctttcagaggagccagacgtctccgagaaagaacactattaagacgtgaaagacttcacagaatcctccatcttttaggctttctaccaaaacactacgaaaaggcgataggttgggaccgaaacgataataaaacatacggcaaatttattaatcatgcagagcctaaactagcctggtgtaaagacaataatggtaaaatgcgcttcttattcatggatagttttcacgacatgctaagcgaattcagcgaaaaacatccagaactattagcaaatggaaaaaaaataccactagattggaccatatattacctgagaaaaaaagcattatacaaagcaatcacaaaggaagaactcgcctggattttacttaatttcaatcaaaaaagaggatactaccaactacggggcgaagaagatagagattcagaagctaataaaaaagaatatctggagttaaaggttataggcgtggaagccactggtgaaaaaaaaggtaatgacatatggtacaacatacatttagaaaatggctggatatacagaagatcgtcaaaaaatcccttaaacgactggttaggtaaagttaagtcatttattgtgacaactgatctagacgctgacggaaacccgaaaaaagataaagatgggaacataaaacggagtttcagagcaccatccgaaggggattggacactcataaaaaagagaacagaatcactgctggaaaatagcggacaaacagtaggtcaattcatatataatcatatactagaagagccgtctgcaaaaattcgtggaaacttcattaggacgatcgaacgaaaatattacaaagatgaattaaaagcaatcctagaaaaacaaaaagagttccatcatgaattatcaagcgaatcattactcacagaatgcgctaaagaattatataagcgtaatattgcacaccaagaagttttactaaaaaagggtatgatccatttactactaaacgatatactcttctatcaacggcctctcaagataaaaaaatcgctaatagataactgtccttatgaaaactataaatacgtagacaaaaaatccggcgatataaaagttaaatcaataaaatgcatagcgaaatctaatcccttttttcaagaattcagactatggcaatttgtatcgaacttaagattataccgtaaatcagatgacaaagacgttacgagtgaacatctcgttactacagatgactacgctaatctattcacatatttgaacaatagaaaagatataaaacagagtgtcttgctcaaagaatactttaaaataaaaaaagtaaaaacgatcaacggcgctgagtatcccgtacgatggaactatatcgatgacgataacaaaacatatccgtgcaacgaaacaagatatgatatactccacgcactatcaaaaactgaactgaaatcagaatggctaacaccagagagaacatacagattgtggcacctcttatactccatagaaagtaaagaagaaacaaaaaaagctttaaacaaactcaatctatctgatgattttacagaagcattcctaacaatcaagccattcaaaaaagaatatggaagctactccgaaaaagcaataaaaaaactactcagtctaatgcgaatgggttacttatggtcagaagacgaagctataaaacaagtcggtgcagaaatagaaaaaacgatagaaggcgagctaccagactatgtactacagagactcgaaaaatcacaacataattacaacaaaatatctgactttagcggattacctctatggctagcgagctacattatttatggaagacactcagaggcaaaggaaataatccattgggacaatccggaatcaatgatggcatacataaaagactttcgccaacacagcatgcgtaaccctatagttgaacaatgcgtcttagagacattaagaacggtacatgacatttggaaagaaattggacacatcgatgaaattcatatagaacttggccgagaaatgaagagtacatcagaacaacgtaaagcaataactcagaacgtattacacaaccaaaatacaaacattagaatcaaacttctactccaagaactaaaaaatgataataatattacaggagtcagaccctactcaccaatgcaacaagaaattctccgtatttacgaagaaggtgctttacaaggtttaactaaagaagataaagactataacgacattctcaaaatctcacaaactgctcaacctacgagcaatgaattaactagatataaactatggctagaacaaaaatatcggtcaccatatacgggaaaggctataagcttatcaaaattatttacatcagcttaccaaatagaacatgtcatcccgcaatcgagatacttcgatgactcactatccaacaaagtgatttgtgaatcagaagttaacaccctaaaaaaagcaatgcttggaatggaattcataaagacttgtggcggccaaaaagtacactgcacactattaggagatgtagaaatatacaatgaagaagactacaaagcgtttgtaaacgaacactacagtaataatagaaccaaaagaaacaaactacttatggaagacataccccaagaatttataaacaggcaactcaacgactcaagatatatcagcaaaatggtcaaacaactactatctgcaatcgtacgaggacaggaagaagttgaagccaccagcaaatttgtaataccgtgcaccggaggaattacagacagactaaaaaaagactggggactaaatgatatatggaataacctagtatcacctcgattccaaagaatgaacgcactaactggaagtgaatattttggccactgggaaaacaaagaaggaaaaagagttttccaaacaaccatgccaattcaactacaacaagggttttcaaaaaaaagaatagaccatagacaccatgccatggacgcacttgtaatagcatgtgcatcacgaaacataataagctatctaaataacgaaacagcgcaagatacagaacgacgaagagatttacgacaaaaattatgcgacaagggaggaagtgtacgcaaaccatgggattcatttactcaagacactcaatatgcactaaaagatatcatcgtcacctttaaaaattacgttagaataatcaacaaagcaacaaactattacgaacactataaaacagatggaaagaaaggcatgatctcccagaagggtgacgaattatgggcaatacgtaaacctatgcataaggaaacggtatttggaaaagtcaacctaagaagaccaaagcgcgtgagtctgtctaaagctatagactcagtagacgtaatctgcaatagaaaactgaaaaaatatataaaagcacgcttaaacgaaggattgcaaaaaaaacaaatactaaatatatttaaagaagttaacaacgtatgggaaggcatagatgtaaacaaaatagacatatgggaaatgagtaacgataaggaaccaatggttgcaactcgtaaacaactagatacaagctttgatgaaaaaaaaatccggagcatctctgataccggtatacaaaaaatattactaaactatttgattacaaaaaacaataatccggaactagcatttacaccagaaggcatacaagaaatgaattcaaatatatccgaatataatgaccataaaaaacaccaacctatatataaagtgagagtaaccgaaccactaggcgctaaatatccaattgggaccatgggtaataaccccaagaaatttgtagaggcccaagcaggcactaacctatactttgcaatatacgaggataaagagggcaatcgaaactacgacacaataccgctcaacattgctgcagagcgtctaaatcaacaactatctccagtccccgagaccaacgaaaataacactccactgaaattttacctaagcccaaatgatttggtttatgtaccctctgaagaagaaagacattctggaaacaacatacaacttgataagaataggatctacaagatggtatccagcacaagcaaacaatgctttttcattcaccatagggttgctataagccttgtggataaaaaagaatttagtgctcaaaacaaaatggaacgcagtatagacaatgagcaagtgatgataaagtccgtgtgctggaaattaataaccgacagactcgggaatataataaaagtcataaaatga

SEQ ID NO: 9203 - RNA, 4458 nt, synthetic construct
  misc_feature 1..4458: note = Cas9 variant
  source 1..4458: mol_type = other RNA
atgaaaaacatacttgggctagatttaggaacaaactccataggctgggctaaaatatccattgacgacaacggtaaatatataaaagactccataaaactaggctccagaatcataccaatgtcccaggacgttctttcaaattttagtaaaggcgtcacactctcgcaaacaagcgagaggacttcctttcgcggtgctagacgactccgagaacgaacattgctacgtagggaaaggttacaccgtatcctacacctgctaggtttcttaccgaaacactacgaaaaagcaataggttgggatagaaacgataacaaaacctatgggaaatttataaaccacgctgaacccaaattagcgtggtgcaaagacaacaatggaaaaatgagatttctattcatggactcattccacgatatgttatcagagttttcggagaaacaccctgaacttctagcaaacgggaaaaaaatacccctagattggaccatatattaccttagaaaaaaagcactatacaaagccataacaaaagaagaactagcatggatcctattaaattttaaccagaaacggggatattaccaattacgaggcgaggaagatcgagattccgaagccaacaaaaaagaatatttggaattaaaagtaattggggttgaagctaccggcgaaaaaaaaggtaacgacatatggtacaacatacacttggaaaacggatggatatacagaaggtcaagcaaaaatccactgaatgattggctaggaaaagttaaatcgtttattgtaacaacagacttagacgcagacggcaatcccaagaaagacaaagatggaaacatcaaaaggagttttagagccccaagtgaaggagattggacacttatcaagaaaagaaccgaatctctacttgaaaactcaggccaaacagttggacaatttatatataaccacatattagaagagccatcagccaaaataaggggaaacttcattcgaacaatagaacgaaaatactataaagacgaactcaaggcgatattagaaaagcaaaaggaatttcaccacgagcttagctcagagtcacttttaacagaatgtgcaaaagagctatacaaaagaaacattgcacaccaggaagtactgctaaaaaaaggaattatacacctactgctaaacgatatattattctatcaacgtccactaaaaataaaaaaatcactaatagataattgcccatatgagaactacaagtacgtagacaaaaaatcaggtgatataaaagtcaagagcattaaatgcattgcaaaatcaaaccccttcttccaagaatttcgtctatggcaatttgtttcgaatctccggctataccgtaaatcagatgataaagacgtaacatcagaacatctagtaaccacagatgattacgctaatctatttacatatctcaataatagaaaggacataaaacaatcagttttactaaaggaatatttcaaaataaaaaaagtaaaaacaataaacggagcagaatatcccgttcgatggaattatatagacgatgacaacaaaacgtacccatgcaatgaaacaagatacgacatcttacatgcactcagcaaaactgaactaaaatctgaatggctaacaccagaacgaacatacagactttggcaccttttatacagcatagaaagcaaagaagaaacaaaaaaggcattaaataaattaaacctatccgacgattttaccgaagcctttctaacaataaagccttttaaaaaagaatacggatcatattcggaaaaggccataaaaaaactgttatcattaatgcgcatgggatacctttggtccgaggatgaagcaataaaacaagtaggagcagagatagaaaaaacaattgaaggagaattaccagactacgtattacagagattagaaaaatctcaacacaactacaataaaataagtgacttcagtggcctaccactttggttagccagctacataatatatggtcgacattcagaagcaaaagaaatcatacattgggacaatccagaaagtatgatggcatatataaaagatttccggcaacactccatgagaaacccaatcgttgagcaatgtgtattagaaacattaagaactgtccatgacatctggaaagaaatcggacacatcgatgaaatacatatagaactaggcagagaaatgaaatcaacgtctgaacaacgcaaagctataacacaaaatgttctacataatcaaaataccaatatacgaattaaactattacttcaagaactaaaaaatgacaacaacattacaggggtaagaccgtacagtcccatgcaacaagagatacttcgaatttatgaagaaggcgctctacaaggcttaacaaaggaagataaggactacaatgatattctaaaaatatcacaaacagcacagccgacatctaacgaattaacaagatataaactctggctagaacaaaagtatcgaagcccctatacaggaaaagccatatccttatctaaattattcacaagcgcataccaaatagaacatgtaatacctcagtctcgatactttgatgattcactctcaaacaaagtaatctgcgaaagcgaggttaatactctaaaaaaagcaatgctgggaatggaatttataaaaacatgtggagggcaaaaagtacactgcacacttttaggggacgtagaaatatataatgaggaagattataaagcattcgtaaacgaacattacagcaataataggacaaagagaaataaactcttaatggaagatatacctcaagagtttataaatagacaattaaacgacagtagatacatttcaaaaatggtaaaacaattactatctgccatcgtacgcggtcaagaagaagtagaagcaacctctaaattcgttattccgtgtacgggcggcatcacagaccgattaaaaaaagattggggacttaacgacatatggaataatctagtatcccccagatttcaacgaatgaacgctctcactggaagtgaatacttcggacactgggaaaacaaagagggaaaaagagtgtttcaaacaacaatgccaatacaactccaacaggggttcagtaaaaaacgtatcgaccaccgacatcacgcgatggacgccttagtgatagcctgtgccagtagaaacatcatttcctacttaaacaatgaaacagctcaagacacagaaaggagaagggatcttcgccaaaaattatgcgacaaaggcggaagtgtcagaaaaccatgggatagcttcacacaagatacacaatatgcactaaaagatattatagtcactttcaagaattacgtacgaataataaacaaagccaccaattactatgaacattacaaaactgacgggaaaaaagggatgatatcacaaaagggagatgagctatgggcgattcgtaaacctatgcacaaagaaaccgtattcggaaaagtaaatctcagaagaccaaaaagagttagcctatcgaaagctatagactctgtagatataatatgcaatcggaaactaaaaaaatatataaaagcaagattaaacgaaggtttacaaaaaaagcaaatattaaacatttttaaagagctcaacaatgtatgggaagggatagacgtaaacaaaattgacatctgggaaatgtctaacgacaaggaaccaatggtcgccaccaggaaacaactagacacatcgttcgatgaaaaaaaaatacgatcaatcagcgacactggtatccaaaagatcctgctcaactacttaataacaaaaaacaacaaccctgaattggctttcacaccagaaggaatccaggagatgaactcaaatatcagtgaatataacgatcataaaaaacatcaacctatttataaagtaagagttacagaaccacttggagctaaatatccaataggaactatggggaataatcctaaaaagttcgttgaagcacaagcaggaacaaatctatacttcgccatatatgaagacaaagagggcaagagaaattacgacactatacctctcaacatagccgctgaacggctaaatcaacaattatccccagttcccgaaactaacgaaaacaatacccccttaaagttctacttaagtccgaacgatctagtatatgtcccatcagaagaagagagacactcaggaaataacatccaactagacaagaatagaatttacaaaatggtttcatccacttccaaaagatgtttttttatacaccacagagtggcaatatcgctagttgataagaaagaatttagtgcccaaaataaaatggagagatcaatcgacaacgagcaagtcatgataaaatcagtatgctggaaacttataacggaccgattaggcaatataatcaaagtcataaaatga

SEQ ID NO: 9204 - RNA, 4458 nt, synthetic construct
  misc_feature 1..4458: note = Cas9 variant
  source 1..4458: mol_type = other RNA
atgaaaaatatattaggacttgatcttggaaccaattcaatcggatgggccaaaataagcatagatgacaacgggaaatatataaaagattcaataaaattaggatcccgcatcattcccatgtcacaagatgtcttatccaacttctcaaaaggggtcacgctatcacaaacaagtgaaagaacttcgttcagaggagctagaagactaagagaacgtactctattaagaagagaacgcctacacagaatactacaccttctaggttttcttcccaaacattacgaaaaagcaataggttgggaccgcaacgataacaaaacatatggaaaattcataaatcatgcagaacccaaacttgcatggtgtaaagacaacaacggaaaaatgaggttcctatttatggattcattccatgatatgctatccgaattttctgaaaaacacccggaactcctagccaacggtaagaaaataccattagattggacaatctattaccttaggaagaaagccctctataaagcgattacaaaagaagaattagcatggatactactaaactttaaccagaaaagaggttattatcaacttagaggagaagaagaccgggattccgaagccaacaagaaagaatatctagaattaaaagtaatcggtgtagaagcgaccggtgagaagaaaggcaacgacatatggtataatatccatttagaaaacggctggatttaccgtcgatcttccaaaaaccctttaaatgactggttaggcaaagttaaatctttcatagtcacaacagatctagatgcagatggaaacccgaagaaagataaagatggaaacattaaaagatcattcagggctccaagcgaaggcgattggacactaattaagaaaagaactgaatccctattagaaaatagcggccaaaccgtagggcaatttatatacaaccacatattagaagaacccagtgccaaaataagaggcaacttcataagaaccatagaaagaaaatactacaaagacgaactcaaagctatattagaaaaacaaaaagagttccaccatgaattatcgtccgaaagtctcttaactgaatgtgctaaagaactttataaacggaacattgctcaccaagaagttttactcaagaaaggaatgattcatttactattaaacgacattttattttaccaaagacctctaaaaattaagaaaagtctaatagacaactgtccatatgaaaattacaaatacgtagataagaaaagcggagatattaaagtaaaaagcataaaatgtattgccaaatccaatcccttctttcaggaatttagattatggcagttcgtttccaatctaagactatacagaaaatctgatgacaaagatgtcacatccgaacaccttgtcaccactgacgattatgccaatctttttacctacctcaataaccgtaaagacatcaaacaaagcgtactcttgaaagaatattttaaaattaaaaaggtaaaaaccataaatggagccgagtacccagtccgctggaactatatcgatgatgacaataaaacctacccatgtaatgaaacgcgatacgacatactacacgccctatctaaaacagaactcaaatcagaatggctcacccccgaacgcacatatcgcctgtggcacttattatacagtatcgaatcgaaagaagaaacgaagaaagcactaaacaaactaaatctctcggacgacttcacagaagcgtttctcacaatcaaacctttcaagaaagaatacggttcatactctgaaaaagcgatcaagaaattattatcgctaatgagaatgggatatctatggtcagaagacgaagcaataaaacaagtcggagctgaaatcgagaaaacaatcgaaggagaacttccagattatgtcctacaaaggcttgaaaaatcacagcacaattacaataaaataagtgacttctcaggcctaccactatggctggcatcatacataatatacggaagacatagcgaagcaaaggaaattatacattgggacaatcctgaatctatgatggcatatatcaaagatttccgccaacactcaatgagaaacccaatagtagaacaatgtgtactagaaacacttaggacagtacacgacatatggaaagaaattggacatatagacgaaatacacattgaactcggacgagaaatgaaaagcaccagtgaacaacggaaagccataacccaaaacgtactacataaccaaaataccaacattagaataaaactactacttcaagaactcaaaaatgataacaacataacaggagtccgaccttactcccccatgcagcaagaaatattgcgaatttatgaagaaggcgcacttcaaggtttaacgaaagaagacaaagactataatgacattctaaaaataagccaaacagcacaaccaacttcaaatgaactcacaagatacaaactctggctggaacagaaatatcgaagcccttataccggtaaagctatatcactaagtaaactattcacttcagcatatcaaatagaacacgttataccacagtcacgctattttgatgattcactcagcaacaaagtcatatgcgaatcggaagtaaacacactaaagaaagcaatgctaggcatggagttcatcaaaacatgtggaggacaaaaagtccattgcacactactaggggacgtagaaatatacaacgaagaagactacaaagcattcgtaaacgaacactattcaaataatagaacaaaacgtaataaactactgatggaagacattccgcaagagttcatcaacagacagctcaatgatagcagatacatctccaaaatggtaaaacaattactctcagccatcgtacgcggacaagaagaagtagaagcaacaagcaaattcgtaataccatgtacaggaggcatcacagaccgactcaagaaagactggggcttaaatgatatatggaataatttggtaagcccgagattccaaagaatgaatgcattaacaggatctgaatattttggtcattgggagaataaagaaggtaaacgagtttttcaaacaaccatgccaatacaactccaacaaggattcagcaagaaaagaatagaccatagacaccacgccatggacgcactcgtaatagcatgcgcttctcgaaacataataagctacttaaacaacgagacggcccaagataccgaaagaaggcgcgacctaagacagaaactctgtgataaaggcgggtctgtacgaaaaccatgggacagttttacacaggatactcagtatgcactaaaagatataatcgtaactttcaaaaactatgtaagaataatcaacaaagctactaattattatgaacactacaaaacagatggaaagaaaggcatgatctcacaaaaaggtgatgaattatgggcaataagaaaaccaatgcataaagagacagtattcggaaaagtaaacctgaggagaccaaaaagagttagtcttagtaaagctattgacagcgtagacgtcatatgcaacaggaaactaaagaaatacataaaagcaaggctaaacgaaggattacagaagaaacagatactcaacatttttaaagaacttaacaatgtttgggaaggaatagatgttaacaaaattgacatttgggaaatgtcaaatgacaaagaaccgatggtagcaacacgaaaacaactagacacttcatttgatgagaagaaaataagaagcataagcgacactggcatccagaaaattctactaaactatttaatcaccaaaaacaataacccagaattagcattcaccccagaaggcattcaagaaatgaatagtaatatatcagaatacaatgaccataaagaacatcaacctatatataaagttcgcgttaccgaacccttgggcgccaaatatccaattggtacgatgggaaacaaaccgaagaaattcgtagaagcacaagctggcacaaatctatattttgcaatatacgaagacaaagaaggaaacagaaattacgatactatcccattgaacattgcagcagaacgattgaatcaacagctttcaccagtaccagaaacaaatgaaaataacactccactaaaattctatctaagccctaacgacctagtttatgttccatcagaggaagaacggcattcagggaacaacatccaattagacaaaaatagaatttataaaatggtatcaagtacctcgaaacaatgctttttcatccatcaccgagtagcaataagtttagttgataagaaagagttctcagctcaaaacaaaatggaaagatcaatcgacaatgaacaagtaatgataaaatctgtttgttggaaactaataaccgatagactaggtaatatcattaaggtaatcaaatga

SEQ ID NO: 9205 - RNA, 4461 nt, synthetic construct
  misc_feature 1..4461: note = Cas9 variant
  source 1..4461: mol_type = other RNA
atgactaaaatactaggactggatttaggaacaaattctatcggttgggcaatacgagaagacgaaaacgaaggagtaaatcaaataatagacaaaggggtaagaatattctcagaaggtgtaaaatcagaaaacggaaaagaaataagtagagccgctgaacgaacagcataccgatcagctagaaaaataaaatatagaagaaaattacggaaatacgaaactctaaaagttttatcggtaaacggaatgtgcccactatcagtcgaagaagttgaacaatggaagaaaagtggatttaaagaatatccactaaacccagagttcctaaactggctacgaacaaatgaagataaaaatataaacccatactttttccgtgacaaagcaagtaaacaaaaagtcacattattcgaattaggacgagcactttaccatatcgcacaacggagaggattcctaagtaatagattagaccaatccgcagaaggagtatttgaagaacacaacccacaaatacaaaacttaatagaagacctagactcaagcaacacaatattaaacgaacttaaagaatattacatcaacctagggataatcgacgaaagtgagaaaagtgggttcaagaaagatcttgatgaaggagagaaaaacctcaagaaactatacacctctttagtcagcataacaaagaaaaacgcaaatgacatagaaacatgcaaacaagaactaatcgcaaggctaaacaagaaagaagaccttggaaaagtgaaaggtgagataaaagacatctcccaagccatgctagatggaaactttaaaaccctaggccaatacttctttagtctatacaacaaaacgcgcatccgaaaccaatacaccagtcgagaagaacattatcttgaagaatttataataatttgtcaaacacaaggaatcgaggaaataaatactaacgaaaaattacctgaaaagaaatttacaggattggcaaaagacctatacagggcaatattctttcaaagaccacttaaaagccaaaaaggactaataggtaaatgttcatttgagaaaaataaatcgagatgtgctgtaagtcatccagattatgaagaatttcgaatgtggagttatctgaataccataaaaattggaacgcaatccgagaaaactttaagattcttaacattagaagaaaaactgaaactcgtacctaaattctatcgtaaaaatgatttcaactttgaagtactagctaaagagctagtcgaaaaaggtgcgtcatttggttattataaatctagcaagaaaaatgaatttttctattggtttaactacaaaccaactgacagtgtaagtgcttgtgtagtatcggcttcactagaaaacgcaatcggaaaagactggaaaacaaaaacgtttgaatatcaaacgagcaataccaagaaagaagaagtaacaaaatcagtaaactacaaagacttatggcatctactctccgtagcaacatccgacacatacttatacgacttcgcaattgaaaaactgaaattggaacccaaaaatgctaaagcattttcaaaaacaaaactcaagaaagacttcgccagcctaagtcttgccgcaatagccaaaattttgccatacttaaaacaaggattgctatacagccatgctgtttttatcgctaatatagaaaatatcgtcgatgcagacatctggaaagataaagaacaacaaaaatttatacaatcgaaaatagttgacttaatagacaattatctagtcgaaaaatcaaaactcgaaatcatcaattgcttacttaaaatctacaacacagaagatatagaaggtaggaaagtctattacagtaaagaagctgaatcgctgttcgaagcggacctaagaaagaaattagtaccgttctacaaagcaaatacaataagtgaacaacaagaacaagaaatcatatttaaagacctatttccggtcttaatcgaacaactcaagaaacaagaatttataaaaatcgtaagactggataagaaaatagaagcatttctaaaaggcgaaaatgaagaaggccaaatattctgcaattacccagagaaattcaagaaactttaccatccaagtgacatagaagtatttaaaaagaaaataatcaaagacgaatgggggaacgaaaaagtggtcctagggtctccactcacgaccagtattaaaaacccgatggcaatgagagcacttcaccagttgagaaaagtcttaaatacattaatactagacggacaaatagatgagaaaacacgaatccatatcgaaatggccagggaactgaatgatgcaaacaaaagaaaaggtatacaagattttcaaaaagaaagggaagaactatacaaaatttacgaagccaaaataaaagaattatatcaagtaaaaacaggaaaagagctactacacgtcactgacgaagacctacaaaaattcgaatgggctctagaacaaacaaaagatggacgaatcatcacaaaagaggaattgataaaatacaaaatatgggaagaacaaaatcatatatgcatatacacgggtaaaacgataagcatagacagcttcctcggcggtaatccaaagttcgacatcgaacacactatcccgagaagcatatcacaagacaatagtctcatgaataaaacactctgtgacaaagatttcaaccgatccgtaaagggcaagaaaatgccagtcgaactttcaaactataatgaaatactgccaagaatcgctcactggaagaaacaagcagaagaactcacaagacaaatagaaacaatcagtcgaagcataaaaagtgctgcaacaaaagtcgcgaaagacaaaaacattcgaaaaagacattatctaacacttaaacgagattatatacaaggaaaatatgacagattcacctggggagaacccaaagtcggattcaaaaacagccaaatacctgacactggaataataacgaaatatgcgcaagcgtacttaaaaagttacttcaagagagttgaatctgtaaaaggcggagcagtagccgaatttagaaaattatgggggatacaggaatccttcatagacgaaaacggctttaaacacttcaaagaaaaagatcgatcaaaacatacccatcacacgatagatgcaatcactatagcctgtatgcccaaagacaaatatgatttattggctcacgcatggagactagaagacgaacaaaacaagaaagccgcaaaagcacttatagaacaagcaaaaccctggaaaacattcaaggaagatatagagaaaatagaagccgaaattctggtttcacactttacgccagataatgtcaagaaacaagccaagaaaatactaagagtacgaggcaagaaacaatacgtagcagaaatagaacgtaacgctaacggcaaagctatacccaagaaagacgcaagcggcaaaataatatacaaactcaatgaaagaggcaataagataccaatccttcaacaaggcgatacaatccggggatcacttcaccaagacagtatatatggcgctatcaaaaaccccttaaacactaatgaaataagatacgtcatccgcaaagaccttgaaagcctaaaagcaaatgacatagaaaatatagtagacgaaaacgtaaaagcgaaggttaaagaagcagtagcgaataagatattattaattagctcaaatccccaacagaaaaacaaattcgcggaaggcaaaaacgtatggatgaatgaggagaagaaaatcccaataaataaagtacgaatatatgccaattcagtcaaaaatccaatcgaaatcaagaaacacagtacgctatcgaaatcaaagcacgaacataaacagaccgtatacggccagaatgatgaaaactacgcaatggcactctatgaactcgatggtaaacgtgaatttgaactaataaacaacttcaatctagcgaaacttttaaaacaaggccaaggctactatcctttacacaaagaaaaagagataaaaggcaagaaagtgctaatacccatagaaaaacgaaataatagagatgtggtgctaaaacggggacaacaagtcgtcttttacgacaaaaccgtagaaaattcaaaagacataagcgaaattgtcgattttagaggaagagtttatctcatagaaggtctcacgatacaaagacaaaaagataaaaagactggaaaagttaatgaatatggcattatacaattaagatacttcaaagaagctagaaaaagcgaagaaatttcaaaagactcatttaaaccagacggcgagttcaaaatcaatgaaaacaaaccaacgaggaaaatgaaccacaaccaattcacagcatttgtagaaggaatagacttcaaagtcctgccatccggcaaattccagaaaatctga

SEQ ID NO: 9206 - RNA, 4464 nt, synthetic construct
  misc_feature 1..4464: note = Cas9 variant
  source 1..4464: mol_type = other RNA
atgaaaaacgtactaggactagatctaggatcaaatagcgtaggatgggctcttgttaaaaccgaagacaatggcaatccaattggaagtataaaaatgggaagtagaataattccgatgtcacaagacatactcggtagtttcgaaaaaggagataccgtctcacaaacagcacaacgtacgctatatcgaggcaaaagaagacttatagaaagacatgtactaagacgagaacgactctgtagagttctacatataatgaacttcttaccagaccacttcgataaattactgggatgggacaaaaccgacaataaaacatatggaaaatttatagatgactcagaacctaaacttgcatggcgccaaaataaaaacgaaaaagagaaaatggagtttgtctttatggatagctttcatgagatgctatcagatttcgcaaaacaccaaccacaattaatagccaatggaaagaaagtgcctttagattggacaatctattatctaagaaagaaagccttgacgcaattgataagtaaagaagagttagcgtggatcttattaaattttaacaagaaaagaggctattaccaacttaggggagaagaagaagaagaacaaccaacaaagaaagaagaatacaaagttctaaaagtaatcagtgtggacgcagatgaaggtcaaaaaggaaacggaatatggtataatatacatctcgaagacggaggtatctataaacgcaaaagcgacaccccactatatgattgggtaggcaaaacgcttcaactaatcgtcgtaactatctacgaaaaagatggtaaaacgccaaaaatcttcgattccggcaaacaaaatccatcatataggctaccaaaagaagacgattggggattaataaagaaacgaacggaaagtcaaatccaatcatcgggtaaaacagtaggtgcattcatatacgataatatcctaagtaaaccagacgacaaaataagaggaaatttagtccgaacgatagaacgaaaatactacaagaaagaacttattgaaatactacaacaacaagcaaaataccacgacgaacttcacaaccaaaatctattagaatcatgtgccaaagaactgtatgctcacaacgacgttagatacaacgaagtagtcaaatcaaatatgattcacctacttgtagatgatataatattctaccaacgcccgttaaaatcaaagaaatcgctaatagcaaactgtaaatatgaatcatacgagtacgtagataaagaaaccggagaagtaaaagagatgccgatcaaatgcatagcaaaatcaaacccatattaccaagagttccgtttatggcagtttatacacaatctaagactatctgacgtcgtaacaagagaagatgtaacagcacaatatttatcaacaccccaagactattgtaacctattcacatacctaaacgatagaaaagaaattaaacaagacatactattaaaagacttcttcaaaataaagaaagtacaaatagacaaagaaaaagttttcccaatagaatggaactacataaaagatgctacgaaaacctatccatgcaacgaaacacgatacgaactactaagtgcattaaaaagggcaggtatggataaacaatggttagacgacactcccaacatgcaatataggttgtggcatcttttgtatagtgtagaggaacaagaagaatcagctaaagcactaagaaaactatatgacaacgataacttcgtgtccagtttcctaaaaatcaaacccttcaagaaatgctatggcgcctactcagaaaaagcaataaaaaggctcctaacactaatgaggatgggaaaagcgtgggatgaacaagcaatcgatgccaaaaccctaaaatgtatacaacaaattataacaggaaacatagactcaaaactaaaagagaaaattgatgactcacgttacgtccttcaccatgtatcggactttcaaggtctaccgacatatcttgctagttacgtaatatacggtagacactcagaagtcactgatataagatgctgggacaccccaaaagacctactaaaattcatatgcggctttccacagcattcattaagaaatccaattgttgaacaagtaatactagaaacattaagggtcgtatatgacatatggaaagcagaaaaacatatagatgaaatacatgttgaagtagcaagagaaatgaaacttactgcccaacaacgaaacgaagccaatctaagaaatttaaataacgaagcgactaacctaagaatcaaatacctactagaagaattaaagaatgacacatttataaaagacgtgagaccattgtcccccatgcatcaagagaaaatgagaatatatgagcaagcggttctcggtaacctaaataaacaagataaagactacgatgatatcatcaaaataagtaagaaagaacgtccaaccagtgcagaactcataagatataaattatggctagaacaaaaatactgctcgccatatacgggaaaagcaataagtttgtcaaaattatttacaaccgcataccaaatcgaacacgttataccccaaagtaggtacttcgacaattctttcaacaacaaagtaatatgcgaatcagaagtaaataaagaaaaagataaaatgttaggatatgaatttataaaaggtcgagggggcgacagaatatattgcacggcacatggaaaagaagtaactatattaaaagaggaagagtacaaacaatttgttaacgaacattacgcacataacaaaagaaaacgagataatctacttgccgagaatatccctgaaagtttttcaagcagacaactaaacgacacacgatatattacaaaaacaattatgagtctactatcaaacgtagttaggcaacaaggagaagaagaagcaaccgctaaaaacctactaccaagtagtggggcagtaaccgataaattgaaaaatgactggggcctaaaggatgtatggaacacaatcgttactccaagattcgagagactaaacaagttgagtggtaccaacgacttcggtgaaatgaaagaagaaaacggaaatagatacttccaaactaacgtaccaagcgaatatgaaaagggattcaagaagaaaagaattgaccatagacaccacgcaatggacgcattagtaatagcatgcacaacaagaaatatggtaaactacatatccaatgtaaatgcaaactctccaaaacaaagagaagacctccgccaattactatgcgacaaaaacagaattattaataaaccatggaatacctttactcaagatgcattaaaagccttaaatgacatagtcgtatcatttaaaaataatgtacggataataaatcgagccaccaataggtaccagagatacgacaaaaatgggaagaaaatgatctgctcccaaaaaggcaatgacatgtgggctattagaaaatccatgcacaaagaaactgtattcggtcgcgttaatttaataagaaaagaagccttaccaattgctaaagcactagataacatatcggcgatatgtaacgcgcaactacgagcctatgtaaacgacttagtagacaaacatttcaataagaaacagctagtcgcacattttaaatcactcgactataaatggaataggcaagacgtgagcaaagttgaagtatggattagctcagacgataaaacaccaatggttgccgtacgcaaacctttagatacatcgttcgataaaaagaaaatagcatctataactgacacaggaatccaagccattttgctaaattatttggaatctaaaggcggagatgctcttgtcgcatttgcgcctgaaggcattcaagaaatgaactccaatatagaattatataacaatggaaaagctcacaaacctatcaaaaacgtaagattatctgagacactcggagcaaaatatcaagtcggcgaaagaggagcaaaaacaaagaaatacgtagtcgcagataaaggaacaaacctattctttgctatatacgaagatgaggaaggaaaacgatattactactcagtccctctaagagaagctatagaacgacaaaaacaaaaactctcgcctgtcccggaatacaacgagaaaggagtagcccttaaattctatttgagtccaaacgatctagtatatgtaccaactgaagaggaacgtacaatgggaacctgtcatatcgacaaaacaagaatatacaaaatggtaagtagtagtgaaaacagatgctgttttgtgccttcaacaatagcaaaagtaatagcggataaagtcgaactattgagtcataacaaaatagagaaagcaattacaggggaatcaataaaagaagtatgctggaaactaaaagtagacagactcggcaacatactaaatgtaataaagtga

SEQ ID NO: 9207 - RNA, 4464 nt, synthetic construct
  misc_feature 1..4464: note = Cas9 variant
  source 1..4464: mol_type = other RNA
atgaaaaacgtacttggacttgacttagggagcaattcagttggatgggccctagtgaaaacagaagataatggaaatccaataggatccattaaaatgggaagtcgaataattcctatgtcccaagacattctaggaagctttgaaaaaggggatacggtatcccagacggcccaaaggactttatataggggtaaaagaagacttacggaaaggcatgtcctacgacgtgaacgattgtgccgtgtgctacacatcatgaacttccttcccgaccatttcgataaactactcggatgggacaaaacagataataaaacgtatggaaaattcatcgacgattcagaaccaaaactggcgtggagacaaaataagaacgaaaaagaaaaaatggaattcgtatttatggacagttttcacgaaatgctctcagacttcgctaaacaccaaccacaactcattgcgaatggaaaaaaagtacctctagactggacaatttattatctaagaaaaaaagctttgacacaactaataagtaaagaggaattagcctggatcttattaaacttcaacaagaaaagaggctattaccagcttagaggggaagaagaagaagaacaaccaaccaaaaaagaagaatataaggtactaaaagtaatcagtgtagacgcagatgaaggccaaaagggtaatggtatatggtataatatacatcttgaagacggaggaatatacaaacgaaaaagcgacataccactatatgactgggtaggtaagaccctccaactcatcgtagtaacaatctacgaaaaagacggaaaaactccaaaaatcttcgactccggtaaacaaaacccaagttatagactacccaaagaagatgattgggggttaataaaaaaacggacagagagtcaaatccagtcgtctggaaaaacagtaggagctttcatctatgataacattctaagtaaacctgctgacaagataagaggaaacttagtcagaacaatagaaagaaagtattacaaaaaagaattaattgaaattctacaacaacaggcaaaataccatgacgaactacacaaccaacacttgttagaatcctgcgccaaagaactttatgcacacaatgatgtacgatacaatgaagtagtcaagtcaaatatgatacatttactagtagatgatataatattctatcaacgaccgctcaaatcaaaaaaaagtttaattgacaactgcaagtatgaaagttatgaatacgtagacaaagaaaccggcgaagtaaaggaaatgccaataaaatgcattgcaaaatccaatccctattaccaggaatttagactttggcagtttatccacaacctaagactatcagacgtggtcaccagggaagacgtaactgctcaatatcttagtaccccacaagactattgtaacttatttacgtaccttaatgatagaaaagaaataaaacaagatatattacttaaagatttctttcagataaaaaaggttcaaattgataaagaaaaagtttttccaatagaatggaactacataaaagatgctaccaaaacatatccatgcaatgaaacaaaatatgagctgctaagcgcattaaaaagagcaggaatggacaaacaatggctagacgatacacccaatatgcaataccggctttggcatcttttatatagtgtagaagaaaaagaagagagcgctaaagcactacgaaaactatacgatgatgataactttgtcagctcattcctaaaaatcaaaccattcgagaaatgctatggtgcatactccgaaaaagctataaaacgccttcttacacttatgcgaatgggaaaagcgtgggacgaacaagccattgacgctaaaacccttaaatgcatccaacaaatcatcactggaaacatcgattcgaaactcaaggaaaaaatcgatgacagcagatatgtactgcaccatgttagcgactttcaaggactacccacgtatctagcatcatacgtaatatacggcagacacagcgaagttacagacattcggtgctgggatacgcctaaagatctcctaaagtttatatgtggatttccgcaacattcactgcgaaatccaatagtagaacaagtaatattagaaacattaagagtcgtgtacgacatatggaaggcagaaaaacatatagatgaaatacatgtagaagtcgccagagaaatgaagttaactgcacaacaaagaaacgaagccaacctaagaaacttaaataatgaagctacaaacttaagaataaaatacctattagaggagttaaaaaatgacacgttcataaaagacgtgagaccattaagtccaatgcaccaagaaaaaatgaggatctatgaacaagctgttcttggaaatttgaataaacaagacaaagactatgatgatatcataaaaatttccaaaaaggaaagaccaacaagtgccgaacttatacgttacaaactatggctcgagcaaaaatattgcagtccatacacaggcaaggcaatatcactgtcaaaactcttcactaccgcttaccagattgaacatgtaataccgcaatcacgctactttgacaacagtttcaacaacaaggtaatatgcgaaagcgaagtaaacaaagaaaaggataaaatgctcggctacgaatttattaaaggacgaggaggagataggatttactgcaccgcacacgggaaagaagtaacaattctcaaagaagaagaatacaaacaattcgttaacgaacactacgcacataacaaaagaaaaagagataatctcttagcagagaacataccagagagcttctcatcaaggcaactaaatgatactagatatattacaaaaaccattatgagtttattatcaaatgtcgtcagacagcaaggagaagaagaagcaacagcaaagaacttattacctagttcaggcgcagtaaccgacaagctaaaaaacgattggggattgaaagatgtatggaacactatagttacaccaagattcgaacgattaaataaattatcaggaacaaacgatttcggtgagatgaaagaagaaaatggaaacagatacttccaaacaaatgttccatcagagtatgaaaaaggcttcaagaaaaaaagaatcgatcaccgacatcatgctatggacgccctagtaatcgcatgcacaacacgaaacatggtcaattatatttcaaatgttaacgctaactctcctaaacaaagagaagacctaagacaattactttgtgacaaaaatcgaataataaataaaccatggaacacatttactcaggacgcattaaaagctctaaacgatatagtagtatcattcaaaaataatgtgagaataataaaccgggcaacaaacagatatcaaagatacgataaaaatggaaaaaagatgatatgcagtcagaaagggaatgacatgtgggccatacgaaaaagcatgcataaagaaacagtcttcggaagagtcaacttaataagaaaagaagcactaccaattgccaaagccttagataacattagtgcgatctgcaacgcccaacttagagcttacgtgaacgatttagtcgacaaacattttaacaaaaaacagttggtagcacacttcaaaagcctagactataagtggaacagacaagacgttagtaaagtagaagtatggatatcatcagatgataaaacacccatggtagcagtcagaaaaccactcgacacatcgttcgataaaaaaaagatagcctcgattacagacacaggaattcaggcaattctattaaactacctagaatccaagggcggtgatgccttagtagcttttgctcctgaaggtatacaggagatgaacagcaacatcgaattatacaacaacggaaaagcacacaaaccaataaaaaacgtaagactcagtgaaactttaggtgcgaagtaccaagtaggcgaacgcggggcaaaaacgaagaaatacgtcgtagccgacaaaggaactaatctatttttcgcaatatatgaggacgaggaaggcaaaagatactactattcggtccctctaagggaagcgatagaacgccaaaaacaaaaactgtcaccggttccagaatataatgaaaaaggagttgcattaaaattctacctaagcccaaatgatctcgtttatgtacctactgaagaagaacgaacgatgggcacctgccacattgataaaacaagaatctacaaaatggtgagttcctctgaaaaccgatgttgctttgtcccatcaacaatagccaaagtcatagcagacaaggttgagctactttctcacaataaaatagaaaaagccataaccggagaatcaatcaaagaagtatgctggaagttaaaagtagatcgtctagggaacatattaaatgttataaaatga

SEQ ID NO: 9208 - RNA, 4464 nt, synthetic construct
  misc_feature 1..4464: note = Cas9 variant
  source 1..4464: mol_type = other RNA
atgaaaaacatcttaggcctagaccttggaagtaattcggtaggttgggcattggttaaggtagaagagaatggtaatcctattggcagcattaaaatgggaagtcgcattatcccaatgtctcaagatatcttaggctcgttcgagaaaggagatactgtttctcagaccgctcaaagaaccctatacagaggtaaacgaagattaatagaaagacatgttctaagaagggaaagactgtgtagagtactgcatataatgaactttttaccagcccactttgacaggctcctaggctgggacaaaacagataataaaacctatggaaaatttatagacgatagtgaacctaaattagcgtggcgacaaaacaagaatgagatggggaaaatggagttcgtatttatggactcatttcacgaaatgctatccgactttgccaaacatcagccacaactaattgcaaacggtaagaaagtaccactagactggaccatctattatctcagaaagaaagccctaacacagctaataagtaaagaagaactagcctggatactactaaatttcaacaagaaaagggggtactatcaattaagaggagaagaggaagaggaacaacccacaaagaaagaagaatacaaagtactaaaagtcatatctgtggacgctgatgaaggtcaaaaaggtaacggaatttggtataacatacatttggaagatggaggaatatacaaaaagaaaagtgatattccattatacgactgggttggcaaaacccttcaattaatagtcgttacaacctatgaaaaagatggaaaaaccccaaaaattttcgactcaggcaaacaaaatccatcatacagacttccaaaagaagacgattgggggctagttaagaaacgaacagaatctcaactacaaagctcgggaaaaactgtaggagcatttatatacgataatattctaagtaaaccagacgacaaaataagaggaaacctagtacgaacgattgaaagaaaatactacaagaaagaattgatagaaattctacagcaacaagctaaataccacgacgaattacacaaccaaaacttactcgaatcatgtgctaaagaattatacgcacataatgatgtacattacaacgaggtaataaaaagtaacatgataaatctattagtaaacgatataatcttttatcagcgacccctaaaaagcaagaaatccctaatagccaattgtaaatatgagtcttatgaatacgtggacaaagagacaggagaaataaaagaaatgcccataaaatgcatagcgaaatctaacccatactatcaagaatttaggttgtggcaattcatacacaacctcagactatcagacgtcgtcacccgggaagatgtgacagcacagtacctctcaacaccgcaagattattgcaacctgttcacatatctgaatgacagaaaagaaataaaacaggacatactcctaaaagatttcttcaaaatcaagaaagtccaaatagataaagaaaaagttttcccaatcgaatggaattacataaaagacgcaactaaatcatatccatgtaacgaaacacggtatgaactactaagcgcgttaaagagagcaggaatggataaacaatggctagatgacacaccaaacatgcaatatcgtttatggcacttattatattctgttgaagagaaagaagagagtgcaaaagcactacgaaaattatacgacgacgacaaatttgtaacatctttcttaaagataaaaccatttaacaagtgttatggagcatacagtgaaaaagctataaaacgactcctcactttaatgaggatgggaaaagcatggaatgaacaagcaatagatgccaaaacactaaaatgtatacaacaaataataactgataatgttgactcaaagctgaaagagaaaattgacgactcgcgctacgtattacatcatgtctctgactttcaaggtctaccaacttacctagcaagttatgtgatatacggacggcactcagaagtaacagatattcaatgttgggattcacccgaagacctcctcaaattcataagagactttaaacaacacagtctaagaaacccaatagtagaacaagtaattttagaaacactaagagtagtatatgacatctggaaagccgaaaaacatattgatgaaatacatgtggaagtagcaagggaaatgaaactaacagcacaacaacgcaatgaagcaaatttgaggaaccttaacaacgaagcaacaaatttacgaataaaatatttattagaagaacttaaaaacgacaccttcattaaagatgttaggccactttctccaattcaccaagaaaagatgagaatatacgaacaagcagttttaggaaacctaaacaaacaagacaaagactatgacgacattataaaaatctctaagaaagaacaccccacaaatgcagaattaataagatacaaattatggttggaacagagatattgctctccttatacaggaaaagcaatatccttatctaaattatttactacagcatatgaaatagaacatattataccacaaagtcgctatttcgacaactccttcaataacaaagtcatatgcgaagctgaagtaaataaggctaaagggaatatgttgggatacgaatttataaagaaacagggaggccagaaaatatactgcacgcaactaggaaaagctgtaacaatactaaaagaagaagcatataaacaatttgtcaacgaacattacgcacacaacaaaagaaaaagagacaacctactagccgaaaatatacccgagagcttttcctcacgacaattaaacgacacacgctacataactaaaacgataatgagtcttctaagcaacgtagtaagacaacaaagtgaagaagaagctacggctaagaatctactaccctcaagtggaagcgtaacagacagactcaaaaatgattggggattgaaagatgtatggaacaccatagtaactcccagatttgaaagactaaacaaattatctggcacaaatgatttcggcgaaatgaaagaggaaaacggaaatagatattttcaaactaatgtacccctagaatatgaaaaaggcttcaagaagaaaaggatcgaccaccgacaccacgcaatggacgcattggtaatagcatgtaccactcgaaacatggtgaattacattagcaatgcaaacgctaacagtccaaaacaaagagaggacctaaggcaattgctatgcgataagaatcgtataataaacaaaccatgggacactttcacacaagacgcgttaaaagccctaaatgatatagtagtaagttttaaaaacaatgtacgtatcataaacagggcaaccaatcggtatcaaagatacgataaaaacggcaaaaagatcatcttttctcaaaagggagatgatatgtgggcgataaggaaaagcatgcataaagaaaccgtttttggaagagtaaatctaattagaaaagaagtcctaccaatagcaaaagccctagacaatatatcggcaatatgtaatgcacaattaagagcatacgtcaacgatctagtagataaacacttcaacaagaaacaactcgtcgcacatttcaaatcattgaattataaatggaataggcaagatgtctcgaaagtagaagtctggattagcagcgacaataaaacacctatggtagctgtaaggaaacctttagatacatcattcgacaaaaagaaaatagcaagcataaccgatacgggcatacaaacaattttactaaactatctagagagtaaaggaggtgatgccagtgtagcattcgctcctgaaggtatacaagaaatgaacagcaacatcgaattatataacaatggcaaagctcataaaccgattaaaaatgtcagattatcagaacccctaggtgcaaaataccaagtaggagaacgtggagcaaaaacaaagaaatatgtcgaagcagataaagggacgaatcttttctttgcgatttatgaagacgaggaaggaaaaaggtactattattcagtacccctacgagaagccatagaaagacaaaaacaaaaattatccccagtacccgaatacaatgaaaaaggtgtagcattaaagttttacctgtcaccaaacgatttagtatatgtcccaacagaggaagaaagaactatgggtacatgtcatatagataaggccagaatatacaaaatggtttccagcacgggatgctcctgctattttgtaccctccacattcgctaaagtaatagttgacaaggtcgaactacaatcattgaacaagatggaaaaagccataacagatgaatgcataaaagaagtttgttggaaactaaaagtggacagactaggaaacataattaatgtaattaaatga

SEQ ID NO: 9209 - RNA, 4485 nt, synthetic construct
  misc_feature 1..4485: note = Cas9 variant
  source 1..4485: mol_type = other RNA
atgaaaaatatactagggttggatttaggaacaaatagcattggatgggccctcatcgacaatgaaagtcatagaattataaagagcggaagtagaataatccccatggacgcagcaactatgggtgattacgaaaaaggaaacctaaaatcggccgactggaaacgaacatcctttcgtggcatgcgaagattgtatgagagagccaaattaagaagagaacgcttgctaagggtcttaaatatattaggatttctgccagaagagtttcgaagacaaatcgattttgaacaccaccccgggcaattcatagatgggaaagaaccactaatagcataccatcacgacgaaaatggtcaaagagttttcagctacatgagcgccttcgaagaaatgttaacagactttcgagcaacacaatccgaactcgtaagagatggaagaagggttccatacgattggacaatctactacctaagacacaaagcattgacacaacctgtaacaaaagaagaattagcatggataatactgaactttaacacgaaaagaggatattatcaattgagaagtgagagcgaagaggtaaccactaacaaaaacgaagaatatgcagaattaaaagtagtatcggtagagaaaaccggcgaagacaagaaacgagcaggatattactggtatacaataacttatgataatgaagcagaacagaaaatcaccagcacaattcctccccgacaaatcggagataaagtcgaattaatagtgacaacagcgcgagataaagctggtgaaataaagaaatcggtcagatcccccaaagaggatgactggactctcatgaaaaagagaacagaacataacatagaagaagaggaatgtacagttggaagctacatatatcaacacatcctagcagacccaaccgtaaaagtacgaggcaaattagtacacactatagaaagaaaattctataaaaaggaactgaaacaaatacttaacaaacaaaaagagttcatacctgaactccaagatgccagtctatatgaagcatgtatcaaagaattatatcgtaacaatgaagcacatatacaatctatagcaaataaagactttactgatctattcgttaatgacataattttctaccaacgtcctctcaaatcaaagaaaagtactataagtaactgcccttatgaatcctattactacaaaaacaaagaaacaggagaattaatcagaaaaccaataaaatgcatagccaaaagtaaccctctctatcaagaatttagactatggcaattcgtacacaatctaagaatatataagaaaagcgaagaagtgtcaggaagactccaaacggatgtcgacgtaactgatagattcctaacaacgccagacgattatgcaaaactcttttcttggctaaatgatcgcaaagaaatcaaacaaaaagaacttctcagatacgaagcatttggattaagtaaatcctacggagactaccgatggaattttgtcgaagacaaaccctacccctgtaatgaaacactccacgaaataaaccgtagaatgaaaagcatacttagcgacaaaaagttatcaagcgaggcatatcaacaattatggcatatattatattctattgacgacccaatagaaatcagaaaagcactaacttcattcgctcaaaatcaagaaatcaactcagatgatttcgtaaacgcattttaccaatacgttccagaaaagacaaaatcatatggtgcatacagtgaaaaggcaataaagaaactgctacctctgatgagacgaggaagctactgggcaataggcaacatagatgagaaaacacaccgtaggttagacaatattataaacggcgtcgctgatgatagcataagtacttgtacgcgcgaaaaacttaacaacttaaccgacataactatgtgccaggggatgcctttatggcaagcatgttacgccgtatacgacagacattcagaagcggcagacactacgaagtgggaacaaccagatgatattgatacctacttatccacagaactcaaacaacatagtctaagaaacccaatagtagaaacagttatttcagaaacactgagagtagtaagggacatctggaaagcatatggcaggcccgaagaaatacatgtagaactaggcagaaacctaaaacaagatgcaaaatctagaaaacaagatgctatacgcatggcagaaaatgaacaaacgaatcttagaatacgcgcactattgcaagaactatcaaaccctgaatgcggagtcgaaaacgtaaggccacacagcccgtctcaaatggaattactaaaaatatatgaaaacgaagtattgcaatcaaccgacgatattcctgaagaaataagtaacataatcaaagacttaggcaaaacagactcaaagaaaagaccaagcctgtcagatattaccaaatatagattatggttagaacaaaaatatcaatcaccctatactggacatataattccattatcaaaactattcacaccagcctatcaaatagaacatgtaatcccacaaagtagatattttgacgactcgatttcgaacaaagttatttgtgaagcggaagtaaataaagaaaaagacaggatgttaggatatgaatttataatcaacaagggcggcagtatagttaaaggttcattcggacaacaatttaaaatctttgacaaagtccagtatgaagatttcgtaaagcaaagatacgctcacaacaaaactaaaatgaagaaattactaatggacgacattccggatggatttatccaaagacaactcaatgattctcggtatatgtcaaagaaaataataagtatcttatcaaacatagtaagagaagatggagaaaaagaagctacaagtaaacatataatagtaacaagtggagcaattacagaccgtttgaagaaagaatggggaataaaagacgtttggaatgatatcatagcgccaagattcaaacgcttaaataaattaaccgatagcaacaattatggcatggaaacggagaaagaaggcagacaatacttccaaattaacgtaccaacggagctatcaacaggcctaatcaagaaaagaatagaccacagacatcatgcaatggatgctataatcatcgcttgcacgacaaggaatcatgtaaactttttaaataactcaaccgcggcatcagaccaaaaagatataagaagggacctacaacacactctatgtactaaaaccaaaacagatagcaacggtaattatgtctggcggttcaataaaccatgggacacatttacacaagatacacgacaagagttagaagggattatagtgtcctttaaacaaaacctacgaataataaacaaaatgtcaaactactaccaacattacgttgacggaaggaaaacgataagtagacaaaacaaaggagatggatgggcaataagaaaatcattacataaagcgacagtcagcggaaaagtaaacctaaaaagaagtaaaacagttggattcaaagaggctttaaacgattggagcgccataaaagacaaaacatctaaagccatactacagaaaataatagcccaatacaaaaactacgatccgaagacaatatttaaatattttaaagaccgtaactttaaagtcgaaggaaaagattttagtaaacttgaagtatactacaataccagcgataaagaaccgatgtcagctcatcgagttaacatagacactacttttgatgaaaaagagatccgcagcattacggacaccggaatacagaaaataatgttaaaacatctacatacctacgatgatgcacaaggaaaaacccaccctgaagcagcatttagtcccgaaggcatagagaaaatgaaccaaaacatacgaatgctaaacggaggtaaagaccacaaaccaatattcaaagtaagaaaagcagaaatcttaggcatgaaattcgccgtgggcgaacgtggacacaaagataagaaatgggtagaagcagataaaggcaccaatctatttttcgcaatatacgaatccgaagaaaataaaagatcatacagtagcattccacttaacgaagccatagataggctaaaaagaggagaaaacatagcagacgaaagagaccaaaacggaaataaactcctctttgtactatctccaatggatctggtctatgtaccagatccagacgatgcacatatagacgaagtgaaaggtaataataatatcttcaaaatggtatcctgcactggaacagaatgttactttgttccggaaacttatgccaacgtaatatgcaaaggaaaggaattagaaagcaagaacaaggttgaaagctatgatggaataaatatcaaaaagtcatgctacaaaataaccgtagatagacttggtaaagttcggaaaatatttaaaggatga

SEQ ID NO: 9210 - RNA, 4491 nt, synthetic construct
  misc_feature 1..4491: note = Cas9 variant
  source 1..4491: mol_type = other RNA
atgaaaactatattggggttagacctgggaacaaattcaataggatgggcaaaagtttgcgtagacgacaacggaaactatctcagagatataaaattaggatctagaattattccaatgtcgcaggacgtactaggaaactttgataaaggcgtaacagaatcccaaacctcagtccgtactggctttcgcggggtaagaagaatcagagaaagatcactattaagacgagaaagactccacagagtattacatgtactcggttatctaccaccacactatgacagtgctataggttggaacaaaaacgaacctagtacttacggaaagttcctaaaccacggagaacctaaactcgcttgggaacataaagaagatggaagtatgcgcttcttgtttatggaatcatttcatgaaatgatggcagattttgcaaaatcgcaaccatcactggtgtcagacggaaagaaaatccctctagattggaccatatactatctaagaaagaaagcattaagccaaccaataaggaaagaagaactagcatggcttttactaaactttaatcagaaaagagggtactaccaactacgaggagaagaagacgacgataatccaactaaatgcgaggaatactatgaattaaaagtagttggaatcgaagcagatgaagaaggcaaaaatggaaacacttggtataacgttaaactagaaaatggatggatttatagaagacaatcgaaaattcctcttgacgactggatagggaaagtaagagagttcatcgttacaaccgaatacgaaaaagacggcatcaccttaaagaaagacaaaaacggtgatgtaaaacgtagctttagaagcccaagtgaagacgattggggactcagaaagaaaagaaccgaaaaactgttagacagtagtaaaatgacagtaggagcttttgtctacgaccacttactagccgaaccaagtgataaaataagaggaaaatttatacgaaccatagaaagaaaatactacaagaaagaactgtatgcaatactatgtgaacaatcaaaatatcacgaagaattaagatcaggggactatctaaataaatgcgcagaagaactatataaaaacaaccaaccccatcgaaactccttgcttaccaaagacctagcatatctcctccttgaagacctaatattctatcaaagaccactcaaaaccaagaaatcattgattgctgaatgtccctacgaagcatacaaatatgtcgataaagaaacaggagaaataaaacgacaaggaataaaatgtatagccaaaagcaatccgtactaccaggagttccggttatggcagtttataagcaacttacgcttatttaataaagcagatgataaagaagtaacggctgattacctcccaacacaagatgactatgtccgtctatttgcctatcttaacgaccgaaaagaaataaaccaagaaaccctactaaaagaatttttcaagctaaagaaaattacggttaattccgaaaaagttttcccaataagatggaactatatagaagacaaagaaaagaaatatccatgcaacgaaaccagacacgaactattactcgcgctagatagagccagaatagaccactcttggctagaaaaaccgggacaagaatatcgattatggcatctgctatattcagttgaaagtaaagaagagacaaaagaagcacttcgaaaattaaaagatgatgacgcatttgtagagtcatttttaaaagtaaaaccatttaaacgggaatatggtgcatattcagaaaaagctattaagaaattattagcagtaatgagaatgggtagtttgtggagagaaacagacatctgtgatacaaccaaaggaaatataacgaaaatcttacaaggcgaaatagatgaaaaactaaaagagaaaatatcagcatcagttagtagttataaccaactaagtgatttccaaggcctccctgtctggctcgcatgttacgtagtatatggcagacacagcgaagctgcagaaattcagcactggaaaaccccggaatcacttttagcttacattaacggtttcaaacaacactcccttaggaatcccattgtcgaacaatgcatacttgaaacactaagaacagttcacgatatatggaaagaagttggacatatcgacgaaatacacgtcgaattaggaaggaacatgaaaagtaccgcagatcagcgagcccgaatttctgaaaatgttctcagaaacgaaaatacaaatctcagaatcaagagtttattgttagaattgaaaaacgaccccaatatcaaagatgtaagaccatacagcccgatgcaacaggagaaactacgaatctacgaggaaggtgtgttgcaagaattaacaaaagacgataaagactttaccgaaataaccaaaattagtactatggcccagcccagcgctaaagaattacaacgctacaagctctggctggaacaaaaatatagatcaccatacactggaaagagcatatcgctaaccaagctattcaccagcgcgtaccaaattgaacacgtaatccctcagtctcgatacttcgacgacagtttcagtaataaggtaatttgcgaatcagaagtaaactcattaaaagataacatgctgggatacgagttcatcaaaaaccacggcggagaaattatacattgtacaatgttaggagacgtaaaggtactatccgaatcagaatacaaagcattcgtgaacgaccattatgcacataataaaagaaaaagagaaaatttattattggaagatataccccaagaatttctaaatcgtcaaatgaacgacagcagatacataagcaaggtagttaaagccctattgagtaatattgtacgagccgaaggcgaagaagaagcaaccagtaaattcgtagtatcatgctcaggaggaattactgaccgtctcaagaaagactggggactaaatgatgtttggaacaaaattgtatacccaagattcgaaagacttaatagactaactggaacggaggcattcggacaatgggaaaataaagacggaaaacgagtatttcagactgcagttccactcgaattacaaaggggattcaacaagaaaagaatagatcatagacaccatgcaatggacgctttagtaatagcctgcacatcacgaaacataataaactatttgaacaacgaatcggccaacaacccaaagaaacgcgaagatcttcgacagaaattgtgcgataaaaacagaaccatcagaaaaccatgggaaacatttacacaagacgctacagcggcactcgaagacgtaatcgtgtcctttaaaaactatgttcgaatcatcaacaaagccacaaactattacgagagatatgatgtagaaggtaagaaagtcattgcagaacagagaggtgatgatatgtgggcgatccgaaaacctatgcatgaagcgacatactatggacgggtcaacctgagacgtaaaaagaaagtaaacctacgcgttgcacttgaaaatatttcatctatctgcgacaacaaactacgtatctacataaacggcttagtagaaaaaggatttaatactaaacaaatactagataaattcaaaaatacaaacgaccacttttcaatgcagaaaatagataaagtagaaatatggcaattcacaaatgaagaagaaaaactggttgcaacaaggaaaccactagacacaagttttgatactaagaaaatagcaagtataactgatactggaatacaaacaattctactaaactatctggaaacaaaaggcggcgactctacaatagcatttaccccagaaggaatagtagaaatgaaccaaaatatatcaaaatacaacaacggtaaagagcatatgccaattttgaaagttagactatatacaaaattaggtaagaaaattccagtcggccaaaccggatgtaaagctaaacaattcgtcatagcggaagcaggtacaaatctgtatttcgcaatatatgaagatgaagaaggtaaaagaagctatcgcacgatcccactcaatgaagtcgtagaacgtctaaaacaaggactatcaccagtacctgagaaaaatgacaaagacgtccatttaaaattttacttgtcaccgaacgaccttgtatacgtaccaatagaagacgaacacgaaagtctcgcaaaagatcacatatataaattcgtggattcaagtggaacgactgcaaattttataccccatagaagtgccaatgtaatatttgaattaaacaagaaagatgcagaaaaattctgtagtggctcaataattcaaaatgaatatggggtcggcagttcccaaagcaaaaatcagaaagcaataacgggtgaaatgataaaagcggtatgtagaaaattggaagtggaccgtctcggtaatgtaataaaagtcatatga

SEQ ID NO: 9211 - RNA, 4497 nt, synthetic construct
  misc_feature 1..4497: note = Cas9 variant
  source 1..4497: mol_type = other RNA
atgaagcacatactcggactagatttaggcactaactcaataggatgggcagttatcagagctcaccaagatgcagatggacatacaacactacaagacatacttgcagccggaagccgaattataccgatggatgccgcaacattaacagatttcgataaaggaaacgcgagaagcggtacagcagaaagaacctcatttcgttccatgcggagaaggcgcgaacgacaactattacgaagagaaaggttacacagagttctaatgctactaggtttcttaccacaacactatgctaattctctcacaagatatggtgagttcgccgataaccgagaatgcaaattgccatgggtaaaagatgaaagcgacggaaaataccactttttatttcaagatgcgtttcacgaaatgtgtgaagattttaggcagttggcgccacaatgggtagcagacggtaaaaaggtcccatatgactggactctatactatttacgttgtaaagctctaagccgaaaaatcagcaaagaggaacttgcatggatcctcctttcttttaatcaaaagaggggatactatcaagcaagagatgaagaagatgaagtaacaacaaataaactagaggaatactacgcaggaaaagtcgtccgtgtcgatgacaccggagaaagaaaagggaaaaatgtatactatgatattactctagaaaatggatgggtatatcgttacgccgcacgaatctatcctgattgggtaggacaagttaaggagttcattgtgacaactacactaaatcctgatggaactccaaaaactgataaagctggtgaagtcaagcgatctttccgcatgcccaaagatgatgactggacattaattaaaaagaagaaagaaagggacatagataggtcacaagaaacaataggacaatatatatatcatgcactcctaaaagatccatcccagaaaattcgtggtaaattaatcggcacagtagaacgaaaatactataaagatgaactacgaagaatactcgacaggcaaattcaattccacccagaactccgtgaccgagaactttactatgcatgtttacaagaattatacccctcaaacgtggcattcagaaatacgctagttaatcgagacttcacatacttgttcctagatgacatactattctaccaacgtccactcaaaagcaagaaatcccaaatatcggattgcccatacgaagaacatttctatacagataaagaaacaggagaaagaattagcgtcccagtcaaatgtatcgctgtctcacatccactctatcaagaatacagattatggcaattcatacaaaacctgcgcatatattgtagagaagcgcgaatagacggtaacttaatgattgattgggaagttacaaatgaactactacaaactgaagaagataaaaccgcattatttgactggcttaacgacaaagaatccgtaaaacaacctgaacttgtagcattcctattaggaggaaaagctaacaagaaacaaatcaaagcgtatagatggaattatatggacgacgacacaaaaggatacccgtgcaatgaaacacgcgcttcattattaaaatatctacgtgaggctcaaacagatagctcatttctaacacgagaacgagaagaagctctatggcatattttatattcgatatcggacaaaggagaactaaaaagcgctttaggtaaattcgccgttaaacatggactaaatgaacgatttgtaactgtattctcaaaattcccacccttcaagaaagactatggtagctattctgctaaagctcttaagaaattactaccactaatgcgtatgggccatcactggcaagaagctagctttataccaagtacaagacaacgcatggagaaattcatcaacggtgaatacgatgactcaatcgacaaaagaacatacgagaaactcgaatctctaaccgaagtatcacaatacagaggtttgccaggatggctcgcatgctatgtagtatatgaccgacattcggaaggacgagatatagaaaggtggacttcaccgtcagatatcgacagctatctagcacaattcaaacaacattcacttcacaaccccatcgtagaaagagtagtattagaaacactacgtacggttcgagatatttggaaacaagttgatcacatagatgaaatacacatagaactgggacgcaacatgaaactaccagcggataaacgacgacaaatgacagaacaagcatggaaaaacgaacaaacaaatttgagaattaaagccctattactagagtttgccagacccggttatgacatcgaaaatgtcagaccatacagcccatatcaacaagatcaactgcggatatacgaagaagcagttcttggcgcaaacgaatgccctgatgatatcagtgcaatattaaagaaattcaatggcttaaacccaccaacaagcgcagaagttttaagatataaatgctggctagaacaaaaatacaggtcaccctacactggcaggaccattcctttaagtaaactttttactagcgcatacgaaattgaacacataatcccaaaacaaagatatttcgacgatagtttctcaaataaggttatatgcgaaagcgaagtaaataagaagaaaggtgcaatgctaggttacgagtttattaaatcgtaccatggggcatctataacattaaatcgaggcggtacagcatcaatattttcagtggaggcatacgaaaactttgtaaaagaacattacgctcacaacagaggaaaaatgaagaaattacttatggatgatgtaccagattcgtttatatctaggcaactaaatgacagtaggtatataagtaaattaatgaaatcaatactaagcaacctagtacgagaggaaggagaaaaagaagccatcagtaaaaaccttatagtttgcaccggtgggataacagacagactaaagaaagactggggtatacatgatgtttggaacgatataatttttccacgatttaaacggttagatgaaatggatagctcacatacatacatcactttaaacacccatcgacatccgattccgtctatgccactagagtttcaacgaggtttttcaaagaaaagaatagatcatcgacaccatgcaatggatgctatagtaattgcatgtgccacaagaaatatagtcaattatcttaacaatgaaagtgcacgacatgatgcaaaaacaagtcgaatggaccttcaaaggctgctatgtacggcaaatagaaaactcatagataaaccttggaaaacatttacgcaagacacatgcaaagtactagaagacatgatagtatcattccaaagaacactacggataataaacaaaactaaaaactactatctgagatttgaggacggtaagaaaagaagggtcttacaaaccaaaggagataactgggcaataagaaaaccacttcataaagaaacattctacggagaaataaatttaagacgaattgaaactttatctctaaacaaagcgctagaacgtataccagacatcgtagagagagatttaagaaagaaactttcagaactacttagcctcgggtacaacgcaaaaagaataaaaggatattttgaagaacataaagaagaatggtcagacgtgaatctaagtaaaataaaggcttactacttcaccaaacagaaaaataaaagatatttcgccgcaagaaccgaacttgatacttccttcaataaagataaaatcgaaaataaaatcgcagacacagcaattcagaaaatacttctacaacatttagaagcatacggaaacgatgtagaacaggctttttcacccgagggaattgacacaatgaatagaaacattagacaactcaatggaggtagatcacaccaacccatttacaaagtaagagtatacgaagaagccacaaaatttgcagtcggccgaagagggaacaaaagtacaaaatttgtagaagcagccaaaggaaccaacctatttttcgctatatatgaaatcagccaagtagatggaaatggaaaccggcaaacatcgagaacattttcatctataccattaaatgtagcagtagaacgattaaaacaaggattaccacccgtaccagaagatgaagaaggaaacgctccaaaatacgttctatcacccaatgatctagtatacttacctacagaaaaagagctcaaaagaagagaaattgcaatgccaatagataaatcgagaatctataaaatggtaagctgtactggcaaagattgcttctttatacccgcgaacactgcggtgcccatagtagatagatatgaatattcctcaatgaacaaaataggtagagccttaacgggcgaaatgataaaggaaatctgtctaccgctaaaaatagatagactaggacaaattattgaaatctctactttctga

SEQ ID NO: 9212 - RNA, 4506 nt, synthetic construct
  misc_feature 1..4506: note = Cas9 variant
  source 1..4506: mol_type = other RNA
atgaagaaaatattaggcctagatctcggaacaaactcaataggctgggcggtcatcaataaagctgaaaacgaaggaaaagacgtactatgcggtattgaagcagcaggatcaagaataatccccatggatgccacgataatgggagacttcgaaaagggaaactcagtgtcacaaacaaaagacagacgagagcacagatcaaccagaagactatacgaacgaggcaaacttcgaagagagagacttaacagggtattatcagttatgggattcctacctgaccactatgtctctcaactcgacagatacggaaaattcctcagcaacacagaaccgaaactagcttgggtacgcaatgccgactgtaaataccattttttatttatggacagtttctcagaaatgctacaagagtttaaaactaacagtccccaatatattagtgaagaaagcaaagtaccatatgactggacgctgtactatctaaggaaaaaagcgctaactcataaagtaaccaaagaagaactagcatggatattacttaacttcaatcaaaaacggggatactttcagctacgagatgaatcagaagaagagaaaaaaccaagcaaaattagacagtattttgaacaccaaaaagtagtggatatcatcgatacgaatgaagtatacaaaggactgaaagtacttatagtaattctagcaaatggaataagcggaaaaatttttaagaaggaaataccagattggataggagtcgaaaaggatattattgtgaaggtggacatcgacaaagatggaaaagataaattcaacgaagatggttcattaagttgccgatttaatataccaactgaagccgaatgggatacagaatgggaactaataaaacagaaaacccaaaatgatttggacgcatctggtaaaacggtcggagaatatatatttgacacacttttacgtaatcccgagcaaaagatacgagggaagctagttagaacaattgaaaggaggtactacaaagaggaaataaatgccattctcaaaaaacaaaaagaatttcacccggaactatcagaccgagctctatatgaaaaatgcgtagaagaactctacccaaacaatccagcacatcgtaatatgatgttaatacatgatttatcatacttcctagtcaacgacatattattctaccaaagaccactaaaatctaaaaaatcactcatagacgagtgcccatacgaatcacacctatatatagacaaaaaaagcggcgaaagaaaaccagtggctgttaaatgcatagctaaaagtcaccctctttaccaagaatttcgactatggcaatttatctccaatcttcgaatttatcagaaaacaaaagaagtaggcaatagcttgaaagtagacgttgacgtcaccaacgaatttttaaagggagaaaatgactatgtagaattatttgattggttaaacactaaaaaagaaatcaaacaagaagacttcctaaaatacaagcctttcgggttcactaaaggcaacattaataactacagatggaactatgtagaagacaaaatctacccttgcaacaaaacacattatactatactgaaaggtttagaaaaagcagatattacatttgacgagttcatttcacatgattcgttagcggaagaaaatctttggcatatactctacagcgtcagctctaaagaagaattaaagcacgcactagaatcgttcgcagacaagcgaggcctatccataaaattcgtagacgcattcatcaacacaccagcgttcgaaaaatcatatggcgcttattcagccaaagccattaaaaaactcttaccgctaatgcgtatgggaaaatattggaaagaagaaaatatatgcgactcgacgcgagaacgcatagacaaaataataacaggagaatacgatgaaaatattagagatcgagtacgagagaagtcaatcaatttaacggacataacactttttcgaggtttaccactctggctagcatgttacgtcgtgtatgatcgacacagtgaagcaggaaatactgagagatggacatcacccagtgacatagatcactacataagaaaattcaaacaacactccctacgaaatcctattgtagaacaaattgttctagaaacattaagaacagtcagagatgtatggaccgaagtaggcggaatagacgaaattcacgtagaattaggcagagaaatgaaaaacccttccgacaagcgacgaaaaatgagtctgcaaatgcaagaaaatgaaaatacaaacttacgaatcaaagcattattagcagaattcatcaacccagaattagggatagaaaacgtacgaccatattccccaagccaacaagacctacttcgtttatacgaagaaggagcatggaactcacccgaaattgatgaaaaacaagtagacgaaatgttagcaatattaaagaaatttaacgaaacagactcaagtaaaaggccaactaaaagtgaaataaaaagatataggttatggctagaacaaaaatacaggtcaccatacactgggacaccaatacctctaagtaaacttttcacgacggcctacgaaatagagcatgtaataccacgaagccgattttttgacgactccttaacaaataaagtaatttgcgaatcagaagtaaataaacttaaaggcaatatgcttggttacgagttcataaaaagccattacggcgaaaaagtgcaactatcaagtggaagtgaagtgcaaatattttcagtgaacgactatgaaaaattcgttaaagaccattattcaaaaaataaagcaaaaatgaaaaaactactcatggatgatataccagaaaaatttacagagcggcaaatgaacgactcgcgatacataagtagactaatagtctcactgctaagtaatatcgttagagagaaaggagaacaagaatcaatcagtaaaaacgtactggtatgtacaggcggagtaacagaccgcttaaaaaatgactggggagtaaacgatgtatggaacaaaataatactaccacggttcaaaagaatgaacgaaatcacagactcgaccgactacacaagtgtcaacacaagtggacacattatcccagcaatgcctctacacttacaaaaaggatttaacaaaaaaagaatcgatcatagacatcacgcaatggatgctattgttatagcatgtgccggaagaaacatcgtaaactacttgaacaaccaaagttcaaaaagcgacgtctcaagacatgatctaagaaacttactatgcgaaaaagataaaagcgatagaaaagaactgataataaagccatgggacacttttacgcaagatgtctacagcgtcttaagttcaataatagtatcaataaaacaaaatttacgcgtaataaacaaaacaaaaaacatataccaacgaaaagaagacgggaaagtgataatttctaaacaagaaaacaatataaactggtgggcaatcagaaaacccttacacaaggagacggtatcaggggaagtaaacttaaggaaagaaactactatctccctaaaagaagcaattgacaatccagccagaataatcgataaagacttcaaaaaaaaactacgtgaattaatactaatgggatataatgaaaaacttataaaaaaatacttctatgacaacaacgagagctggcaagacgtcaatttaaaaaaaattccagcatactactttacaaaagacacaaatgacagatactttgcaagtcgaagcttattagacgaaaacttcgataaaaaaaagatagaaaataaagtaacagacacaggcataagaactatattattacgacacctagaagtagagggaggtgactcaaaagtagcgttttcaccagaaggattagaaagaatgaacaaaaacatagaaattttaaacggaggaaagaaacataaaccaatttataaagtacgggaatatgaaaaagctgaaaaatttgcagtaggcatgagagggaataaagcttcaaagtttgttgaagctgcaaaaggaacaaatttgttcttcgcagtctatgataacggcaaaaaaaggtccttcgcaacggtacccctcaatgaggtcatcagattacaaaaagaaggtttaccatccgccccagcaaatgaagaaggactactgccaaaattcgttctgtcacctaacgatttagtgtatgtcccaacggaagatgaactcagaagtggccttttacccgaaaacccggcacccgaaagaatctataaaatggtatcttgtacgggataccaatgctttttcatacatttctctgtatctggcgttctctgcgataaaaaggaattctcctccttaaacaagatggaacgagcaattagcggagaaatgataaaagaaatatgtataccgttaaaggtgaacagattaggaaagataatgtacaatttgtga

SEQ ID NO: 9213 - RNA, 4506 nt, synthetic construct
  misc_feature 1..4506: note = Cas9 variant
  source 1..4506: mol_type = other RNA
atgaagacaattcttggcctagatctaggaaccaactcgataggctgggcaaaaatatctatagacgataatgggaattatttacgagacattcaacttggttccagaattatacccatgtctcaggatgtacttggaaaattcgataatggagtaactgagtcacaaacagcagttcgaacaggattcagaggactcagaagaataagagaacgatctttactaaggagagaacgactccatcgagtcttacatgttatgggattcttacccccacattatgatagtgcaattggctggaacaaagaagaaccatcaacctacggtaagtttttaaaccacggtgaaccaaaactcgcgtgggaaagacagggtgatggtagcatgcgatttctttttatggacagcttccataaaatgatggaagattttgcaccacaccaaccagccctagtcgcagatggtcgaaaaatacccctcgattggactctatattacctaaggaagaaagcactcacacaaccaatcaagaaagaagaactagcgtggatcttgttaaatttcaatcagaaaagaggctactatcaacttagaggagaagaagaagaagaaaaccccacaaaaagggaagaataccacgaattaaaagtggtatcagtagaagcagctgaagaaggaaagggtggaaatacatggtacaacgtaaaattagagaacggctggatctatcataggccgtcaaagatagacttaagcgattgggtaggtaagacaaagcaatttattgtaacaatggaatatgaagctgacggaataacactcaagaaaaataaggaaggagaggtgaaaagatctttcagagtacccgacgaggacgattggggtttacgaaagaagagaacagaatcacaactagaggcatcaggcaaaacggtaggagcatttatatacgatcacctactagcagaacccgcagataagatcagaggaaactttattagaacaatagaaagaaaatactataaacaagaattagcagatatacttcgagaacaatcgaaatatcatgaagaactacaatcaaagaaaatcttagcagattgtgctgaagagttatatagatcaaatcagcctcaccgggattcactgttgaagaaagacatggtttatctactcctaaccgatttgatcttttatcaaagaccactcaaaagcaagaaatcactcatcgctaattgcccatacgaatactacgaatatgtggataaagaaacaggtgaaattaaaagacaaggcataaaatgtgtagcaaaaagcaatccatactaccaagaatttagactgtggcaatttgtgttgaatctaagattgtatgataggacagaagataaagaagtgacagctgaatatctcccaagtaaagaagattacgcaagactattcgtatatttaaatgaccgaaaagaaataaatcaagagactctcttaaaagatttctttaaactaaagaaagtaaaacagagaagtgaaaaagaatttccagttagatggaactacatcgaagataaagaaaagaaatacccatgtaatgagacacgacacgagttgctaatggcattagacagagcaggcatggaaagaagttggttagacgatacagcgaggcaatatcgcttatggcatttattatattcgatagaggtaaaagatgaagcggaacgagccctacgaaaactaaaagatgatgatgaatttgttagtgcatttttgaaggtaaaaccgtttaagaaagattatggagcatatagcgaaaaagccgtaaagaaactactagcagtcatgcgtatgggatcccattggtgtgaagatgacatttgtaaagaaacaaaagaaagaattgaacacattctacagggagacgtagaagagaaaataaaagaaaggatgaaccatacagcttatagtctaggggaacttagcgatttccaaggattaccagagtggctagcatgctacgtagtatacggtcgacactcggaagctactgatataaaacattggaaaacgcctgagagcttaatggcctatattaacggatttaaacaacattctctacgaaaccccatagtcgaacagtgcattctcgaaactctaaggacagttcatgatatatggaaagaagccggacatattgatgaaatacacgtagaattaggtaggtctatgaaatcaacctctgaccaacgggccagaatgacagaaaatatactaaggaatgaaaatacgaatctcagaataaaatcattattgatggaactcaaaaatgacgctgatataaaagatgtaagaccttactcaccaatgcaacaagaaatcttacgaatatacgaggaaggagcattgcaagaactcaccaaagaagataacgactatgaagaaattttcaaaatcagcaaaatcccacaaccgtctgctaaggagctgcttaaatacaaactttggctggaacagaagtaccgctcaccatacactggtaagcctatttcgctatcaaaattattcacttcagcataccaaatagaacatataataccacaatcaagatatttcgacgacagttttaacaataaagtaatatgtgaatctgaagtaaatgcccttaaaagtaacatgctaggctatgaatttattaaaaatcacggaggcgaaatcgtacactgcacattacttggagatgtcaaggtacaaaacgagtctgaatataaagccttcgtaaccgaacactacgcaaacaataaatacaagaaagaaaaattgctcatggaggatattccacaagactttttgaacagacacttaaatgattcaagatatatatcaaaagtagttaaaaccttgctatcaaatatagtgagaacagaagacgaaatggaaaccacatccaaattcgtagtctcatgtaccgggggaattacagatcgattaaagaaagattggggacttaacgatgtatggaactctatagtctatagtagatttgaacgattaaatgaactgacaaaaagcgatgcatttggcagatgggaaaataaagaaggaaaacgcgttttccaaacaagtgtcccattagagctccaacgtggattcaataagaaaagaatagatcatagacaccatgcaatggatgccttagtcattgcttgtgcctcccgaaacatcataaactacttaaataatgaaagtgcaaattccccaaagaaaagagaagacctacgacaacaattatgcgataaaaatagaattatccgaaaaccctgggaatcattcacgcaagatgcgagagcagccctagaagatgttgtcgtatctttcaaaaactatgtaagagtaattaacaaaacaacaaactattacgagagatatggagctgatggagagaaaactattgcaaaacagaaaaactcggaaatgtgggcagtaagaaaacctatgcacgaagcaaagtattatggcagagtcaacttacaaagaaaaacagaagtacgcttaaaagcagcattagaggatatccctagcatctgcaacaaagagctccgagactatattaatagactcgtaaaatcaggattgaatgctagacaactgttagcacacttcaaaagtacagattattgttggaataaacaaaatgtagataaagtcgaggtttggagatttagtgacgaaaaagaacccctagttgctataagagaatcattagacacatctttcgatgcaaaaagaatcgacacaattaccgatacaggtatacagaaaattttgttaaactatttagaagctaaaggaggcgaccctgcaatcgcttttacaccagaaggaattgctgaaatgaatcaaaacatggcattatacaataatggaaaaatgcaccagccaatattaagagtacgtttatcaaagaaacgaggtaagaaatatcaggtaggacaaacaggatgcaaagcaaaacaattcgttatatcagaatctggaaccaacctatacttcgcgatatatgaagacgaagatcgcaacagaacatataatactataccactaaacgaagttgcagagagactaaaacagggtttatcaccagtaccggaaaagaacgaaaaagaagtaccacttaaattctacctatcacctaatgatcttgtctacgttccaacagaagaggaaatacttatgaaggaatgtaaattgaacaaaaacagaatatataaatttatagattcatctggcacaactgccaattttgtaccacatagaagtgcatcgttaatatacaacgtcgataaaaagctggctgaagcattttgcaacgacgaaataatacaaaacgaatacggcgtaggatcaccacaaagcaaaaaccaaaaagcactgacaggagaaatgatcaaagcagtatgttggaagttagaagttgaccgactaggtaatataatacgagtaataaagtga

SEQ ID NO: 9214 - RNA, 4515 nt, synthetic construct
  misc_feature 1..4515: note = Cas9 variant
  source 1..4515: mol_type = other RNA
atgaaaaatatagttggactggatctaggaacaaacagcataggatgggcagtagtaaatggcaatataaacgacgatggtagtgaacaattagtaaaaatacaggcttccggtagcagaatcataccaatggacgctgccatgataggagacttcaacaaaggaaatagtatatcacaaacagcagaaagaaccagattgagaggcatacgaagattatctgaaaggtacctcctgagaagagaaaggctccaccgcatactcgatatcctcggctttctaccgagccatttcgcaagagacctagatagatacggaaagatagtaaaggacaaagaacccaaattagcatggcgcaaaaatgaagcaggtcaattcgaatttatatttcaaaattcatttaaagaaatgctagaagatttcaaacttaatcacccaaatcttataacggatgataagaaagttccctacgattggacgatatattacttacgtaagaaaggtcttaccagcaaaatctctaaagaagaactagcctggattttattgaactttaaccagaaaagagggtattaccaattaaggggtgaagaagaagaagaaaacaaaaataaacaagttgagttctatgccctaaaagttatcgccgtagaagactcaggcgagaagaaaggaaaagacacatggtacaatgttcacttagaaaacggatggatatatcgaagaacgagtaacatgcctcttgactgggtaggaaaaacgaaagaatttatagttacaactgatttagaaaaagatggcactccaaagaaagataaagaaggtaatataaaaaggagcttcagagctccaaaagaagacgattggagcttagtgaaaaagaaaacggaagctgacatagatcaaactcataaaacagtcggaacatatatatacgacacgttattaggtaacccaagccagaaaataagaggaagactggtacgaacaatcgaaagaaaatactataaagaagaattaaaattaatcttagacaaacaaaaagagttccatccggaacttcaagatagagctctttacgctgcatgtgtggaagaattgtatactataaacgaagcacatagaaataatattggaaatagagacttcacatatttatttttggaagacatacttttctaccaaagacccctcaagagtaagaaatcactcatagataactgtccctacgaagaaaatcattgtttagacaaagaaacgggagaaataaaattctttcccgtcaaatgcatagccaaatcccatcctctatttcaagagttccgactatggcaatttatagtcaacctacgtatataccgaaaaggactagcacaggatgtagacgtgaccaacgaattactaaaaactgaagaagactacgtagcactcttcgactggttaaacggtaagaaagaaatagaccaaaaagcatttttaaaatacccaccgtttggattaaagaaagaagttgaaaactacaggtggaactatgtacaagataaatcatatccctgtaacgaaacaagatcacttatgttggcccgattagaaaaatgtgacataagtatcgaatttcttacaaaagaaaatgaagaggctttatggcacatattatactcagtcgaagataaaaacgaaatagttaaagcactacaaaaattcgcagataaacacaatttaaacgccagctttgtagatgtgttccaaaaatttccatcattcaagaaagaatatggtagttactctgcaaaagccatcaagaaattactacctctaatgcgaatgggaaaatattggtctgaagatagtatagacaaaggaaccagagaaagaatggataaaataataacaggagaatacgacgaaaagatagaaaatcgagtgcgagaaaaagcaatacacctcgcagatataagcgagttcaaagggttacccttatggttagtatgttatatagtgtacggacgtcattccgaaagtaaagaaatagcaaaatgggaaagcccagcagacatagattcatatcttaaatcattcaaacaacattcactccgaaacccaattgtagaacaaatcataatcgaaacactaagagtcgtacgagatatctggaaacaggtcggaaacatagatgaaattcatgtagaattagggagagaaatgaaaaatcctgcagacaaacgaagaaaaatgacacaacaaatatcagaaaacgaaaatacaaatcttagaataaaataccttctaacagagttcttaaaccccgaatatgaagtagagaatgttcgaccatatagtccaagtcagcaagacatattacggatatatgaagaaggagtattaaattcagtatccaacctaccagaagagatatcagatatactaaagaaattcacagaaacagacctgaaaaagagaccatcaagatccgaagtacttagatacaaactatggttagaacaaaaatacaggtccccgtatactggagaagtaatccccttaggaaaactatttactcctgcatacgaaatcgagcacgtgataccacaaagccggtacttcgacgactcttttagcaataaagtaatatgtgaagcagaagtaaataaattaaaaagtaatctcttaggtcatgagttcatagtaaagcaccatggggaaatcgttgaactaccatttggcaagaaagtcaaaatttttacggtagatgaatatgaacaattcgtgaaagataactacagtagaacaagaggaaaaatgaagaaactattagtagacgatattccagaagagtttgttgctcgacagctaaacgattcaagatatatatcaaaagtagtaaaaagtttgttaagcaacatagttagggaaaaaggagaggaagaggccatatctaaaaacgtcatcccatgtacgggtggagtcactgacaggcttaagaaagattggggagtcaatgatgtatggaacaaaataatcctaccgcgattccaacgactaaatgaattaacaggtactaataaatttacaacaatgagcttaaacaatcacgaaataccagccatgccacttgagcttcaaaagggatttaataagaaacgaatagaccataggcatcacgcaatggatgctataataatagcctgtgccaatagaaacataataaactacctgaacaatgaatcagcaactgccaaagcagaactcagtcggtatgacctacaaagattattatgcgataaagcaaaaaccgacgacaacggtaactacaaatgggtaataagaaaaccatgggcatcttttacacaagacgtacatggtgtactagaggacataatagtatcctttaaacagaacttaagagtcataaacaaagcaacgaaccatttcctacactataacgaagaaggaaagaaaatcttcgtaaaacaagagaaaggagactcatgggcaattaggaaaagtatgcacaaggacacagtatttggtgaagtaaacctaagaagaatcaaaaccgtagcactaaacgaggcaatgaaaaatccacaaagcatagttgtaaaagactttaaaaggaaactactagaactcttaaatctcggattcgacgcaaaacgaattaagaaatactttgaggacaatcgagaaacttggagcgacataaatttatcaaaaataacagtttattacttttctaaagatacaaaagaccgctttttcgcaacaagaaaaccattagatacaagttttgacaggaagaaaatagaaaacaacataacagatacagggattcagaaaatacttttacgacatcttgagttaaaagacaacaacccagacatcgcgttcagtcccgacggtatcgatgaaatgaaccgtaacataatacaactaaataatggaaaataccatcaaccaatcataaaagtaagatggtacgagcaagcagataaattcgcagttggacaaacgggaaataagagtagcaaattcgtggaagccgcaaaaggtacaaatttattctttgctgtatatgaatcaaacatactggacgagaaaaccaacacaattatcaagaaaagaaactacgctacaatcccactaaacgtagcaatagaacgacaaaaacaaggcttatcggtcgcacctgaagaagaaaacggcaatgacccgatattcgtcctttctccaaacgatttggtctacctcccgacaacagatgagcttgcaaatggcgtagtagcacagccacttgataaagaacgaatatataaaatggttagttgcacaggaaatgagggtcactttatcccagcgcgaattgcaaatccaatcctccaaacaatcgaattgggatcgaataacaaagcccagaaagcatggacagatgagatgataaaagagatctgcatgcctataaaagtggatagactaggtaacatcttggagtcaagcagcctgcataagaaatga

SEQ ID NO: 9215 - RNA, 4515 nt, synthetic construct
  misc_feature 1..4515: note = Cas9 variant
  source 1..4515: mol_type = other RNA
atgaaaaacatagtcggtttagacctcgggacaaattcaataggatgggccgttgtaaacggatcagttaacgacgatggctcagaacaactagtaaagatacaagcctccgggagtcgaattattccgatggacgccgcaatgattggagacttcaataaaggaaactcaatatcgcaaacagcagaaaggacaagattacgaggggttagacgcctgtcagaacgatacctactacgcagggagcgactccatcgaatattggatatcttaggatttttaccattccattttgcacaagatctggatcgccatggaaaaatagtaaaaggaaaagaaccaaaactagcctggagaaaaaacgaagcgggacaatttgaattcatttttcaagactcatttaaggaaatgctagaagatttcaaattaaactatccaaatttaattactgacgataagaaggtaccatatgattggaccatatactacttacggaaaaaaggactaacctcaaaaatatcaaaagaagaattagcatggattctactaaactttaaccaaaaacgaggatactatcaattacgaggagaagaagaagaagagaacaaagacaaattagttgaattctatgcactcaaagtagtagctgtagaagattctggagaaaaaaaaggcaaagacatctggtacaatgtccacttggaaaacgggtgggtctatagacgtacgtcaaacatgtcactggattgggtaggaaaaactaaagaatttattgtaacaacagatctagaaaaagacggaacaccgaaaaaagataaagaaggaaatgtgaagcgatcattccgagcaccaaaagaagatgactggtcattagtaaaaaaaaaaacagaagctgacatagatcaaacccacaaaacagttggcgcctacatatatgacaccctactaggtaatccatcgcaaaaaattcggggaaggctagtaaggacaattgaaagaaaatattacaaagaagaattaaagcttattctcgaaaagcaaaaagagttccatctcgaacttcaagatcgcgccttatatgcagcctgcatagaagaattatacccaataaacgaagcacaccgtaataatgtaggaaaccgagattttacatatttatttctggaagacatactcttctatcaacggccattgaaatcaaaaaaatcacttatcgacaattgcccctatgaagaaaaccaaggactagataaagaaactggagaaatcaaatcatttcctgtaaagtgcattgctaaaagtcatccattattccaagagtttagattatggcaatttatcataaatctcagaatatatagaaaagacttagcacaagatgtcgatgtaactaatgaacttttaaagacagaagaagattatgtagcgctatttgactggttaaatgggaaaaaagaaatagatcagaaagcattccttaagtatcccgtatttggtttaaaaaaagaaatagaaaattaccgatggaattacgtgcaagacaaaccatacccgtgcaatgaaacgcgaagcttaatgttagcacgcttagaaaaatgtgatatctccatcgaattcttaacaaaggaaaacgaagaagcactatggcatatactatacagtgttgaagacaagaacgaaatagttaaagcacttcaaaaatttgcagataaacacgatctcaacgcaagctttgtagacgtatttcaaaaatttcctccctttaaaaaagaatatggaagttactcagcaaaagccattaagaaactactaccacttatgcggatggggaaatattggtcagaaaacagcatagataaaggaacccgtgaaagaatagataaaattataactggggaatacgatgaaaaaatagaaaatagagttagagaaaaagcgatacatctcgcagatgtatcagactttaaaggattaccactatggctagtatgttatatagtatatggaagacattcagaagctaaagaaataatacagtggaaatcaccggcagacatagactcataccttagaagctttaaacaacatagcttacgtaatccaatcgtcgagcaaataatcatcgaaaccttacgtgtagtacgagacatatggaaacaagttggcaatattgatgaaattcatgttgagctaggtagagaaatgaaaaatcccgcagacaagagaaaaaaaatgacccaacaaatgtcagaaaatgaaaatacaaacctaaggataaaataccttttaacggagttcctaaacccagaatatgaggtagagaacgtccgaccctactccccatcacaacaagatatattgagaatttatgaggagggagtattgaatagcgttagtgatctaccagaagaaatttcagacattttaaaaaaatttaccgaaacagatctcaagaaacgccctagcaggagcgaagtattaagatacaaattatggctcgaacaaaaatacaggtctccatatacaggagaagtaattccactaggaaaactattcacacccgcctacgaaatagaacatgttataccccaaagctgctactttgacgatagtttctccaacaaagtaatctgtgaagcggaagtaaacaaattaaagtccaatctactaggtcacgaatttatagtaaagcatcacggagagatagtagaactaccgttcggcaaaaaggtaagaatattcacagtcgacgaatatgaacaatttgttaaagacaactactccaggactcgcagtaaaatgaagaagctacttatggatgatatacccgaagagttcgtcacaagacaattaaatgattcaagatatataagtaaagtagttaaaagcttattatcaaacatcgtaagggagaaaggggaagaagaggcgataagcaaaaacgttataccttgcaccggtggagtaacagataggctaaaaaaagactggggaataaatgaagtttggaacaaaatcatcttaccccgattccaaagactaaacgaacttacaggaaccaataagtttacaactaaaaacgtaggaattcaagaaataccaaccatgccattagaactacaaaaaggattcaacaaaaaaagaatagatcacagacatcatgcaatggatgcaataattattgcatgtgcgaaccgaaatataataaactacttaaacaatgaaagtgcaacagcaaaagcagaactatcaagatacgatctacaaaaaatgctatgcgacaaagcaaagaccgataataatgggaactacaagtgggttattagaaaaccctgggcatccttcacacaagacacatatctagccctagaaaacataatagtttcgtttaaacagaacctccgtgtaataaacaaagcgacaaacaggttcttacactataatgaagaaggcaaaaaaatatttgttaaacaaggaaaaggagataactgggccatacgcaaatcaatgcacaaagataccgtctttggtgaagtcaacttacggagaatcaagacagtagcactaaatgaagcgatgaaaaatcctcaaagtatagttgttaaagattttaaacgaaagttactagagttatggaacctaggtttcgacgcaaaacgaataaaaaagtatttcgaagataacagagaaacctggtcagatattaatttatctaaaattgaagtttactacttttcgaaagataccaaagacagattttttgcaacacgaaaacctctagatacttcttttgaccgaaaaaaaatagaaaacaacattacagataccggaatacaaaaaatcttattacgccatcttgaattaaaagataataatccagatatagctttttctccagacggaattgacgaaatgaatcgaaatataatccagttgaataacggtaaatatcatcaacccataataaaaattaggtggtacgaacaagctgataaatttgcagtcggtcaaacaggaaataaaagttcaaagtttgtcgaagcagcaaaaggaacaaacttattcttcgcagtgtatgagtcaaatatactagataaaaaaacaaacactatcataaaaaaaagaaactatgccactattccactaaatgtagccatagagagacaaaaacaaggcctcccggtagcacctgaagatgaaaacggaaatgatccaatattcgtattatcacccaacgatttggtatatctccctacagacgatgagcttgcaaacggaattatagctcaacccttagatagaggaagaatatataagatggtatcgagcagtggcgaacaatgttttttcataaagcatatagtcgccaacgtattagtagacaaattcgaattcagtcccttaaataaaatggagagagccctaactggtgagatgattaagatgatatgtataccaattaaagtcgacaggctgggcaacgtacttgaaagctcatccagttacaaaaaatga

SEQ ID NO: 9216 - RNA, 4515 nt, synthetic construct
  misc_feature 1..4515: note = Cas9 variant
  source 1..4515: mol_type = other RNA
atgaaaaatattgttggacttgaccttggcaccaacagcataggatgggccgttgtaaatggatctgttaacgatgacggatccgaacaattagtaaaaattcaagcatcaggttctcgaataatacctatggacgcagcaatgataggggacttcaataaaggtaacagcatatcacaaaccgccgaaagaacacgactcagaggagtaagacgtcttagcgaaagatacctcttaaggagagaaagactacaccggatactggatattctagggttccttccattccactttgcacaagacctcgaccgtcacggcaaaatagttaaaggaaaagaaccaaaattagcatggaggaagaacgaagcaggacaattcgagttcatatttcaagattcatttaaagaaatgttagaagatttcaaactaaaccacccgaatctgattacagacgacaaaaaagtaccatatgattggacaatttattacctcagaaaaaagggcttaacatcaaaaatctcaaaagaggaactagcatggattttactaaacttcaaccaaaaacgaggttattatcaattaagaggagaagaagaagaagaaaataaaaataaattagtcgaattctatgccctcaaagttgtcgccgtagaggactctggagagaaaaaaggcaaggacatatggtataatgtacatcttgaaaatggctgggtgtataggaggacaagcaacatgccattagattgggtaggaaaaacaaaagaatttattgtcactaccgacttagaaaaagacggaacgccaaagaaagacaaagaaggcaacgtaaaacgttcattcagagcaccaaaagaagatgattggagtttagtaaaaaaaaaaaccgaagccgatattgatcaaacccataagacagtcggagcgtatatatacgatacattgttaggcaatccaagccaaaaaatcaggggtagactagtgcgtaccatagaaagaaagtactataaggaagaactaaaacaaatcttagaaaaacaaaaagaattccacctagaattacaagacagagcactatacgccgcatgtattgaagaactctatcctataaatgaagcacatcggaacaacgtgggaaatcgggactttacatacctattcttagaggacattctattttatcaaagaccactaaaatcaaaaaaatccctaatagataattgcccatacgaagaaaaccaaggattagacaaagaaactggtgaaataaaaagctttcctgtaaaatgcatagccaaaagccatccactattccaagaatttagattatggcaattcattatcaatctccgcatatacagaaaagacctggcacaagacgttgatgtcaccaatgaactcctgaaaaccgaagaggattacgtggcactattcgattggctaaacggaaaaaaagaaatagatcaaaaagccttcttaaaataccctgtattcagattaaagaaggaaatagaaaactacaggtggaactatgtacaagacaaaccgtatccttgcaatgagacacgtagcctcatgctagcccgcttagaaaagtgcgacatttctatcgagtttttaacgaaggaaaacgaagaagccctctggcacatcttatactccgttgaggataaaaacgaaatagtaaaagcactacaaaagttcgcagataaacacgacctcaacgcaagcttcgttgacgtatttcaaaaatttccgccttttaaaaaggaatatggttcctactcagcaaaagcaataaaaaagttactaccattgatgagaatgggaaaatactggtcagaaaattcaattgataaaggaactcgagcacgaatagacaaaataataactggagaatacgacgaaaaaatagaaaatagagtaagagaaaaagcgattcacctcgcagatgtatcagactttaaaggacttcctctatggttagtatgctatattgtctatggacgccactcggaagccaaagagataatacaatggaaatctcctgctgacatagactcatacttaagatcatttaaacaacattcattacgaaaccccattgtagaacaaatcattattgagactttaagggtcgttagagatatatggaaacaagtaggaaatatagatgagatccatgtagagttaggccgagaaatgaaaaaccccgcagacaaaagaaagaaaatgacacaacagatgagtgaaaatgaaaatacaaacctccgtatcaaatatttattaactgaattccttaacccagaatacgaagtcgaaaacgtccgtccatactctccatcgcaacaagacatactaagaatatacgaagaaggagtattaaattctgtaagcgatttaccagaagaaatatcagacatattgaaaaagttcactgagactgacctcaaaaaacgcccatcacgttcagaaatactccgttacaaactatggttagagcaaaaatacagatccccctacacaggagaggtaattccattaggcaaactatttactccagcatacgaaatagaacacgttatccctcagtcctgttactttgacgattcatttagcaataaagttatctgtgaagccgaggtaaataaattaaaatcgaatttactaggtcatgaatttatagtaaaacaccatggtgaaatcgtagagttgccattcggcaaaaaagtaagaatattcaccgtagacgagtacgaacaattcgttaaagataactatagccgaacaagatcgaaaatgaagaaactcctaatggacgacattcctgaagagtttgtgacccgacaactcaacgattctagatacatcagcaaagtagttaaatctctactttcaaatatagtgcgtgaaaaaggtgaagaagaagctatcagtaaaaatgtgataccttgtacaggcggagtcacggaccgattaaaaaaagattggggaataaatgaagtttggaataaaatcatattacctagattccaacgactgaatgaattaacaggaacaaacaagttcactaccaaaaatgtgggattgcaagaaatacccaccatgcccctagagcttcaaaaaggcttcaataaaaaaagaattgatcataggcatcatgccatggacgcaataataatcgcatgtgctaacagaaacataataaattacttaaataatgaatcagcaactgcaaaagctgaattatcaaggtacgacttgcaaaagatgttatgtgacaaagcaaaaactgacaacaacggcaattacaagtgggtcatcaggaaaccatgggcaagctttacccaagatacatatctagcattagaaaacatcatagtgagttttaaacaaaatctcagggtgataaataaagcgacaaatcgatttttgcattacaatgaagaaggaaaaaaaatttttgttaaacaaggaaagggagataattgggcaatcaggaaatcgatgcataaagatacagtgttcggagaagtaaacctaagaagaataaaaacagttgctctaaacgaagccatgaaaaacccccaatctatcgttgtaaaagactttaaaagaaaactgctagagttatggaacttaggcttcgacgctaagagaattaaaaaatacttcgaagataacagagaaacatggagcgacataaacctatccaaaatagaagtatattattttagcaaggacacaaaagatagattttttgctacgcgaaaaccattagacacaagtttcgatcgaaaaaaaatcgaaaacaacataacagacacaggaatacaaaaaatcctactcagacacctagaattaaaagacaataaccccgatatcgcattctcaccagatgggatagacgaaatgaatagaaatatcatacaactcaataacggcaaatatcatcaaccgataataaaagttagatggtatgaacaagcagataaattcgcggtaggacaaacaggaaacaaattctcgaaattcgtagaagcagcaaaaggaacaaaccttttcttcgcagtttacgaaagcaacatactagacaagaaaactaatacaataataaaaaaacgcaattatgcaacaataccacttaacgtcgcaatagaaaggcaaaaacaagggctcccggtagccccagaagacgagaacggaaatgatccaatatttgtcctcagcccaaacgatttagtatacctgcctactgatgacgaactagcaaatggaataattgcacaaccactagaccggggacggatatacaaaatggtctcatcgagtggcgaacaatgcttctttataaaacatatagtagcgaacgtactggtagataagttcgagttttcacccctaaacaaaatggaaagagcattaacaggtgaaatgattaaaatgatttgcatacccatcaaagtagaccggttaggtaatgtccttgaaagctccagttctcacaaaaaatga

SEQ ID NO: 9217 - RNA, 4515 nt, synthetic construct
  misc_feature 1..4515: note = Cas9 variant
  source 1..4515: mol_type = other RNA
atgaaacggattcttggattagatttaggaacaaactcaataggttgggccttaattgaaaacgattttaatagaaaagaaggaaaaattgaagcactaggatcaagaataatacctatgtcccaagatatactaggaaaatttgatagcggagtaacagtatcccaaactgccgcaagaacgaactaccggggtataagacgtctatatcaaagagacaacctgcgtagagaaagattacatagagtgctaaacatattagggtttctcccaaaacactatgcagaatcaatagatttcgaagatagattaggccaatttaaaccagaaacagaagtaaaattaccctatcgaaaagattcagacgacaattatcactttatattccaagaatcattcaatgaaatggttgaagaatttcagttcaaaaacccctctttattttataccaaagcaaatggagaacaatccaaaataccatacgactggacactatactatctacggaagaaagccctatcaaagaaaatatcaaaagaagaattagcatggattctattgaatttcaatcagaaaagaggatattaccaattacgaggagaagaagaagcagattctaaagacaaattagaagaataccatgcacttaaagtaagcgacgtacaagctaccgaagatacaaacgccaaaggaacttggtataacgtaattctcgaaaatggctggatatacagaagacaaagcaaagatagcctatttgattggaaaggaaaaacgagagaatttatagtaacaacgagcttagaaaaaggcggagcagtaaaaatagataaagaaggcaacgaaaaacgtagtttcagagccgtagattcagaaaaagattggattgccataaagaagaaaacagaaaatgacctagcgaatgccggcacaaccgtgggcgtttacatatatgaaacactacttagaaatccggatcagaaaataagaggaaaactaatcaaaacaatagaaagaaaatattacctagaagaattaaaagccatacttgccaaacaaatccaagaacacgcggaattacaaaacaggagcttatacaaagactgtatagaagaattataccaaggaaacgaagcacacaaaaacaacattaaagaaaatggcttcgactacctcttcctagaagacattatattttaccaacgtcccctgaaaagcaagaaatcgaccataagtaactgtccctatgaaagcagggttttcataaaagacggaaagaaagaaatacagccaattaaatgcataagtaaaagtaatccaatataccaagaatttagactctggcaattcattcataatctgaaaatatatgaaaaagaagctatagatgatggaaaaactgtgataaacaaagatgtaaccacggagttcttaaatacccaagaagcctatgcagctcttttcgaatttctcaacgataaagctgaaatatcacagaacgcactcttaaaatatttcaaactttcaacaaatacacacagatggaacaatgttgaagataagaaatatccatgcaacgaaacaagatcagagttcataaaaagactaagcaaaatggatggcatagacctgggcaaaaccctctccccagctttcgagaaaagtctttggcatattatatattccgttaaagacaagaaacaatatgtaagagcactagaaacatttgccatgaaaaacggattagacatcaaccaatttagagaaaattttgaaaaattcaaaccgtacgattccgcatatggagcttactcagaaaaagctctaaagaaagtattgccgctaatcagacgcggtacatactggaagaaagatgccatcccagccgcagtccaagaaagaatcgtaaatataatgaaacgaatagaaagcgtagattttaatctcgagaaaatcgaaaactttgccgacgacgacatacccaaacaactacttaaatcttttgcaaaaggcaaagatcccatgcaaggcctcaatacgtaccaagcatgctacgccgtttataatcggcatagcgaagtttcagacatacaactttggaaatcaccagaagacataaccaaatacttagattcattcaaacagcattccctaagaaacccaattgtagaacaagtagtaatggaaaccttacgagtagtacgtgacatatggcagtactatggaaacggagctaaagacttctttagtgaaatacatgtagaattaggacgtgaaatgaaaaacgacaagaaaacaagagaaaggatctccaaatccataacagaaaatgaaaacactaacgaaagaattaaaaatatactaaaagaattaatgggagatgaagccctacaaggagatataagaccctatagtaaaggacaccaagatatattaaaactttacgaagaaggcgtgttcgcaaacgctcctgaaacgtacaaaaacataaaaatagatgatatcgagaaaattcgtaaaaacaactccccatcaaaatccgatattgtaaaatataaactttggttggaacagggctacatatccccgtacaccggtagccctatacccctatcacgactattcacaacagattatcagatagaacatattattccccgatcacggtattttgatgatagcatgggcaataaaatcatatgcgaatcagctgtgaatgaagaaaagacaaataaaaccgcctatgagttcattaaagaaaatgcaggacgaataatagacttaggtcaagggaaacaagtccccttgttcgatctcgaagcatatgaatcacattgcagaggttattttaagggaaacaccaagaaattaaaatttctcctatcggaagacatacctgaaggatttataaatcggcaattaaatgattctcgatacatcagcaaagtagtaacatcattgctctcaaatgtagtgagagaagaaggagaacaagaagctacaagtaaaaacctcgtacctctcgttggaacaataacatcaaaactaaagaaagactggggactcgaagcaatatgggacgacttaatagcccctcgatttgaacgtatgaatcaactaacaaaaagcacagatttcaggaaggaggtaattgatggacatggtaatcgatactttataaatacagtacccgatgatatcaagaaaggttttagtaagaaaagaatagaccatcggcatcacgccctagacgccctagtaatagcctgtacaaccaaagatcatgtcaattatattacgtcactaaacacacaacgaaataacagatctctagtaagcaaattaagaaagatagaagagaaaaccataaaagataagagaacaggtcaaccaaaaacaataaaaatagcgaaagcgtaccataagccttggccaaattttacgaaagaaacattcgagaaactaagcaaaacagtagtcagctttaaacaaaaccaacgtatcattaacaaaactaacaacaagacatggggatgggaaaaagtagacggcgtaatgaaaaaggtgttaaagaaacaagagaaaagaaactgggcaataagaaaaccaatccataaagagacctactacgggaaagtaaaaggattcgattcgccaaaaggtaaaataacgacagccactcgcaaaagcctacgggaaataactaatgaacgacaactaaacaccattacagacagtggcatcaagaaaattctaaataaccacttaaaaacattcatcgatgaatcaggtaaaataaacttcgagccagcatttaaccaagatggaatagatctgctaaataaaaacatccaacaattaaacgaaggcaaaaatcaccaaccaatctataaagtgagaatgtatacacacaacacaatgtttagtgttggagacgaaggaaataaatctacaaaatacgttatcccagaaagcggaaccaacttattctttaatgtatactgggacgaagaaaataacaaaagaaatttcgagactgtaccacttaaccgtgtcatagcattccaaaaacaaacaagtcacatcccaagaaaagacagaaccgatgtacctatagacaacacacttggaaggtttctatttacactatctccagatgacctagtgtacctaccaacagatgaagaatctgaaagttttactacattcgaaattgatagtcttaattcaaagcaagtagcaaatatctataaattcgtggacggttctggtacaacaggcaacttcgttccagcggaggcagcgcgagtaatagccaacatcaaagataagaaagtaagatcaaatttttgtaaaaggaacaacctatcagacaagcagcttatcaaaaacgagttcggactaggtagtccccaactgaaaaatcaaaactcattagacggtcgacaaatcaaatcaatatgctggaaactagaaataaaccgattaggaaaaatcatcaaagtcattaaatga

SEQ ID NO: 9218 - RNA, 4515 nt, synthetic construct
  misc_feature 1..4515: note = Cas9 variant
  source 1..4515: mol_type = other RNA
atgaagaaagtactaggtttggacatcggaactaatagcgtaggatgggcagtagtaaaccaaaatgataaaggtgagttcctctcgatagagaaaataggatctcgcattataccaatgtctcaggacgtaatggacaaatttggagcggggcaaaccgaaagtagtacagctcagagaactcaatatagaggagtaagaagactcagagaaagaagcctcctaagacgagaaagactacaccgggtattacacatattacactttctaccgcaacactatgatgcagcaataggttggaacaagaaagaaaataaaacttatggtaaatttttacctggagtagaagtgaatatcccctgggtcgcaacagatcaaggtcaccaatttattttcatggactcttatgccgaaatgcttaaagacttgaaacaacatcaacctcatctgttcgaaaaatctagtaccccggtacctctagactggactatttattacttaagaaagaaagcactaacacaagctatctcaaaagaagaattagcatggatactactaaatttcaatcaaaaacggggttactaccaattacgaggtgaagaagttgaagataacacaaaaagagaagagttctatgcactcaaagtggtaaaagtggaactagataaagacaacactagcgcaaaaacatggtacaaagttcatctcgaaaacggctttatctatccatgcccttcagacacaccaatcgacagttgggtaggtatggtaaaagacttcatagtgacaacaacattggaaaaagatggaagcgaaaaacgtacggccgacggagaaataaaaaggagcttccgagcacccaaagaagacgattggacgcttttaaagaagaaaacagaatctgaacttgaaaaatcagggaaacaagttggggcatttatatatgacacacttctatcaaacccagatcagaaaataataggcggactaataaaaaccatagaacgaaaatattataagaaagaattagaacaaatactcgaaacccaacaaaaatttatagcagaattaagtgacaagaaactctttcaggcttgtgccgaagaattgtatccactaaatgactcacacagggaaaacctattagaaagagactttaaacatttattcgtacaagacataattttctaccatcgaccgttaaaaacaaagaaatcactaatcagcaattgcacatacgaataccgtaccttttacaaaaacggggaaaaacaaataagtccaatcaaatgtatagctaaatctaacccattatttcaagagttccgagtatggcaattcgtacaaaacctaagaatactacaaagacaaagatcagaaggcgactcaattaaatacaacgtcgacgtaaccgcagaatttctcaaagacgaaaacgatatagcaaatctattcacgtggctcaatgaacgaaaagtaatcaaacaagatcaattactcaaatcatattttaaattaaaagtgaacaaagaaactaaagaattggactaccgttggaattacgttgatgacaaaaataaagaatatccatgcaacgcaacacgaacacacattctgagtttcctcgaaaaatgcaaagaagaaaaacgaatagaagatgatagattcgtgtacagtttatggcatctattatactcagtcgtagaaccaatcgaattaaggggagccttagcaaagttcgctgaacgagaacatcttcaccccagcttcgtagatgttttcgcacaatttccgcctttagaaaaggaatatggatcatactcagaaaaagctataaaaagactactaccattgatgagaatgggagactactggcacgaagataaaatagacgtaaagactaaacaacgaatacaacgcattatagacggcgaagcagatgacgatataacacatcgatcacgagaaaaggtcgaaaacctccgatctataacagacttcaaaggtctgccactttggaaggcaggatatgtggtatacaaccgtcatagcgaatccggcgaactcacaaaatggaagactccacatgaactaagtaattatattcaaaacgagttcaaacaatattccctaagaaatccgatagttgaacaaatagtactagaaacactccgtgtagtgcacgacctttgggttaaacatggcgatttctcagaaatccatctagaattaggccgcgacatcaaaaatagctctgacaaacgcaaaagaatggccgaaagacaacaagaaaacgaaaactcaagacaacgagttctagagatgctcatagatctcaagaaagaagcagcatttgctgacctaaatccatacagtccaagtcaacaagaaaaattacgaatagtagaagatggggtattaagaagtaacatagaaatcccaaaagacatagagaaaataacaaaatcggcaaaaccgacgagcagagaattaaccaagtatcgactctggcttgaccaaaaatacagatcaccctatacgggtcaaccgataagcctcgcacaactattcacatcaaaatacgaaatagaacatgttattccgcaagccaaatatttcgatgattcattcacgaacaaagtgatatgtgaatcagaagtaaacaaagaaaaaggatcgatgctagcgcacgagtttatcttaaagaatggaggatcgacggttaacgtcggaggtcgacaagttcaagtcctcaaaaatgacgcttatgttgaactaatcaatagactatacggcaaaaacaaccccgttaaagcaaagaaattgttagcagaagacatagacgaagtagtaggagatttctcagaaagacaattaaatgatacacgatacatatcacgcgtagttcaaaaactgttatccaatatagtcagagaagaagacgaacaagaatctacaagcaaacatgttattggatgttcaggacaagtgacaaccgcgcttaagaaagattgggggttaaacgacatttggaacaaaataatccaacccagatttgaaagacttaatgaaatgacagccaccgaggactacggagtatggcaatcaccaaaccactttcaaataagggtaccagaagaaattcaaaaaggatttactaagaaacgaatagaccatagacaccatgcaatggacgcattggtgattgcgtgtgccacgcgatcgcacatcaactatatcagtaatagatcaggacaagaccgaaatgctaaatttgaaacaacgagaacagatttaagatcaaaactgtgttataaagagaacagtagcggaaacaattataactatatatttaataaaccatgggatacattcacgcaggatgcacacagggctcttgaaaatatcgtcgtatcccataaacaaaacctcagagtgcttacgaaaacgaataattacacacaatttatcaataaagatgggaagaaagacctccaaaaacaagtaaaaggcgaccattttgcagtacgaaaacctatgcatcaagaaactatatatggcagagtttcaatcagatctataaaagaagttgctttgaagaaagccttggaaaattggaaacaaatagtcgatagaactctgaaagacaaaatacgagaactaataggcgcctatggaaaatatgacgcccaaacaatcctcaaatacttcaaagacagggactacaaatttaacaatctaaaaataaatcgagtagaagtctatgaatacgatcataattgcgcagcagtaagaaaatcaatcggagatgacttaactataaaacaaatagagagaataactgacgaaagcataagaaaaatacttatgaatcacttatccaattatgacgataatctaaaggaagcattcagtccagaaggcctcatggaaatgaataaaaatataaaagaactgaacggagggaaaaatcaccaaccaatttacaaagttagattatttgaagacttaggatcaaaatttcccctgggagtatctcataacaaccctgataagtacgcaatcgccgcaaaaggaacgaacctatttttcggaatctatgaagatcaagaaggaaaaagaatgtttgactccatacctctaaacattgttattgataggcttaaagaaaagaaatcaccagtgccggaaacttataacgaaagtaaattaaaatttcatcttagcccgaacgaccttgtatatgttccaaccgatgaggaacaaaaacaaccagaattagtagatgtagaccacctatcagatgagcaaaaaggacgggtatataaagcagtttcatttacgggaaatcgagccttctttgtaaatcatcgagtttccaaagtcatacatgattatgttgagtttggcacgaaaaataaaatagaaaacgatgatgataaaagatccttaaaacacatatgctggaaactaaaagtaaatcgattaggcgaaataacagacgtaaaacgatga

SEQ ID NO: 9219 - RNA, 4515 nt, synthetic construct
  misc_feature 1..4515: note = Cas9 variant
  source 1..4515: mol_type = other RNA
atgaaaaacattgttggactcgatcttggaactaacagcataggttgggcagtagtaaacgggagcgtcaacgatgatgggagcgaacagttagtaaaaatacaagctagcggatcaagaataatacccatggatgctgcaatgataggagactttaataaaggaaactcaatatcccaaacagcagaacgaacccgactccgaggagtcagacgactaagcgaacgatacctactcagaagagagagactacatcgaatactagacatcttgggatttctaccattccattttgcacaagatcttgaccgtcatgggaaaatagtaaaaggaaaagaaccaaaattagcatggaggaaaaacgaagcaggacaatttgaatttatatttcaagattcattcaaagaaatgctcgaagattttaaacttaactaccctaatctaattacagacgacaagaaagtcccttatgactggacaatatattatctaagaaagaaaggattaaccagtaaaatcagtaaagaagaattggcctggattctactaaacttcaatcagaaaagagggtactaccaacttcgtggagaagaagaagaagaaaacaaagacaaattagttgaattttacgcactaaaagtcgtagccgtagaagattcaggtgagaagaaaggcaaagacatatggtataacgtacacttagaaaatggttgggtctatcgaagaacaagtaatatgagcttagattgggttggaaaaaccaaagagttcatagtaaccaccgacctagaaaaagacggcacaccgaagaaagacaaagaaggaaacgtcaaaagatcatttagagctcccaaagaagacgactggtcacttgtcaaaaagaaaacggaagctgatatagaccaaacacacaaaaccgtaggagcatatatatatgatacactattggggaaccctagtcagaaaataagagggagattagtacggactatagaaaggaaatactataaagaagaattaaaactaatattggaaaaacaaaaagagttccatttagaacttcaagacagggcactttatgcagcttgtatcgaagaactatatccaatcaacgaagcacatcgaaacaacgtcggaaatagagacttcacatacctttttctcgaagacatactcttctatcaaagaccactaaaaagcaagaaatcattaatagataattgtccatatgaagaaaatcaaggactagataaagaaacaggagaaataaaatctttcccagtgaaatgcatagcaaaaagccatcctttatttcaagagttcagactctggcaatttataataaacctaaggatctatagaaaagatctcgcacaagacgtagacgtcacaaatgaacttttaaaaacagaagaagattatgtcgcattattcgattggctaaacggcaagaaagaaatagatcaaaaagcgttcctaaaatatccggtgttcggtctaaagaaagaaatagaaaattatcgttggaattatgttcaagataaaccatatccatgtaacgaaacacgctctctaatgttagctagattagagaaatgcgatatctcaattgaatttctaacaaaagaaaacgaagaagccctatggcacatcctatactcagtggaagacaaaaacgaaatagttaaagcgctacaaaaatttgcagacaaacatgaccttaatgcttcttttgtagacgtttttcaaaaatttcctcccttcaagaaagaatacggaagttatagcgcgaaagcaatcaagaaactgttgccattaatgcgaatgggaaaatactggtcagaaaactcaatcgataaaggtacacgagaacgaatcgataaaatcataacaggtgaatacgacgagaaaatagaaaatcgagtaagagaaaaagcaatacatttagcagatgtatccgattttaaaggacttccattatggctggtttgttacatagtgtatggcagacatagtgaagccaaagaaataatacaatggaaatctcccgcagacattgattcgtatcttaggagcttcaaacaacactcactaagaaatccaattgtcgaacaaataataatagaaaccctacgagttgtaagggacatatggaaacaggtaggaaacatagatgaaatccatgtagagcttggacgcgaaatgaaaaatccagcagacaaaaggaagaaaatgacgcaacaaatgtcagagaatgagaacacaaacctacgtattaagtatcttttaacagagttcctaaatccagaatacgaagtagaaaacgtcagaccttactctccatcacaacaggatattctcagaatatatgaagaaggagtactaaactccgtatcagacctaccagaagagatcagtgacatactaaagaaatttacagaaacggatctcaagaaacgaccttcacgctcagaagtccttagatacaaattatggctcgaacaaaaatatcgatccccatatacaggggaagtaatacccttaggaaaactctttaccccagcttatgaaatagaacacgttattccgcaaagttattacttcgatgacagcttttcaaacaaagtaatatgcgaagcagaagtaaacaaactaaaaagtaatctattaggacacgagttcatagtaaaacaccatggcgaaattgtagaactaccattcggcaagaaagtcagaatatttacagtggacgaatatgaacaatttgtaaaggacaactattcaagaacacgaagtaaaatgaagaaactccttatggatgacattccagaagagttcgtcacaagacaattaaatgacagcagatatatatctaaagttgtcaagagcctgttatcaaatattgtacgcgaaaaaggtgaagaggaagcaataagcaaaaacgtaataccgtgcacgggcggagtaacagaccgacttaaaaaggattgggggataaatgaagtctggaacaaaattatcttacccagattccaacgcttaaatgaactaactggaactaacaaattcacaaccaaaaacgtaggcatccaagaaatcccaactatgccactagaactacaaaaaggttttaacaagaaacgtattgaccacaggcaccatgcgatggacgcaatcattatagcatgcgcaaatcgaaacataataaactacttaaacaataaatcagctacagctaaagccgagctgagccggtacgacttgcagaaaatgttgtgtgataaagcaaaaacagataacaacggtaactataaatgggtaataagaaaaccatgggccagcttcactcaggacacatatttagcattagaaaacataatagtcagttttaaacaaaacctcagagtgataaataaagcgacgaatcgctttcttcattacaatgaagaaggcaagaaaatttttgtaaagcaaggtaagggagacaactgggcgatacgcaaatctatgcataaagatactgtattcggagaagtaaacttacgaagaataaaaaccgttgcacttaatgaagcgatgaaaaacccacaatccatagtcgttaaagatttcaaacgaaagctactagaattatggaacttaggatttgacgctaaaagaataaagaaatactttgaagacaatagagagacatggtctgatataaacctttcaaaaattgaagtgtattacttctcaaaagacacaaaagatcgctttttcgcaaccagaaaaccattagacacaagtttcgatcgaaagaaaatcgaaaataatattacagatacgggcatacagaaaatactattaagacaccttgaactcaaagataataatccagatatagccttttcacccgacggaatagatgaaatgaacaggaacataatacaactaaacaatggcaaataccatcaaccaattataaaaattagatggtatgaacaagcagacaaattcgcggtaggccaaacaggaaataaaagtagcaaatttgtagaagcagctaaaggaacaaacctattctttgcagtatacgaaagtaatattctagataagaaaacaaatacaataatcaagaaaagaaattacgcgacaataccactaaacgtagccatcgaaagacaaaaacaaggacttccagtagcaccagaagacgaaaatggaaatgaccccatcttcgtactatcgccaaatgatttagtatatctcccgaccgacgacgaactagcaaacgggatcatcgcacaaccactggatagaggacggatatataaaatggtaagtagtagcggtgaacaatgctttttcattaagcatatagtggcaaatgtcctagtagacaaattcgagtttagcccattaaataaaatggaacgagcacttactggtgagatgatcaaaatgatatgtatacctataaaggtcgacagattaggaaacgttctagaatctagctcatcatacaagaaatga

SEQ ID NO: 9220 - RNA, 4515 nt, synthetic construct
  misc_feature 1..4515: note = Cas9 variant
  source 1..4515: mol_type = other RNA
atgaaaaatatagtaggactcgacttaggtactaacagcataggatgggctgtagtgaatggctctgtgaatgatgacggtagcgaacaacttgtgaaaatccaagcatcaggcagtagaataataccaatggacgcagcaatgataggagattttaataaaggaaacagtatttcacaaactgcagaacgaacgcgactcagaggcgtaagacgcttatcagaacgatatttattaaggcgagaaagactacacaggatattagacatattaggattcctacctttccacttcgcccaagatctagacagacacggcaaaatagtaaaaggcaaagaaccgaagttggcttggagaaaaaatgaagcaggacaatttgaatttatatttcaagacagctttaaagaaatgttagaagactttaaactcaaccatccgaatctaattacagacgacaaaaaggttccatacgactggacaatatattacctcagaaaaaaaggtttaacgagtaaaatttcaaaagaagaattagcatggatactactcaacttcaatcagaaaagagggtattatcaattaagaggcgaagaagaagaagaaaataaaaacaaattagtagaattctacgcattaaaagtagtggcagtggaagatagcggtgaaaaaaaaggcaaagatatatggtataatgtacacctagaaaacggatgggtataccgaagaacaagcaacatgccactagactgggtgggaaaaaccaaagaattcatagtgacgacagatcttgaaaaagatggtacaccaaaaaaagataaagagggtaacgtcaaaagatcattccgagcaccaaaagaagatgactggtcactactcaaaaaaaaaacagaagcagacattgatcaaacacataaaactgtaggagtatacatatatgacacactactaggaaacccatctcaaaaaatacgcggaaggctagtcagaaccatagaaagaaaatactacaaagaagaactgaaacaaattttagagaaacaaaaagagttccacctagaacttcaagacagagcgctttatgcagcttgtattgaagaattatatccaatcaacgaagctcacagaaacaacgtcggaaatagagatttcacctatctattcttagaagacatactattctatcagcgacccctaaaaagtaaaaaatcactaatagataattgcccatatgaagaaaaccaaggattggacaaagaaacaggagaaataaaatcattcccagtcaaatgcatcgctaaaagtcatccactatttcaagaatttagactctggcaatttatagtgaacctacgaatatatcggaaagaccttgctcaagacgttgacgtcacgaatgagctactaaaaaccgaagaagattacgttgcactatttgactggctcaatgggaaaaaagaaattgatcaaaaagcattcctaaaatacccggtttttggactaaaaaaagaaatagaaaactaccgatggaactatgtacaagataaaccgtacccgtgcaatgaaacacggtcattaatgctggccagattagagaaatgcgacataagcatagaatttctcacaaaagaaaatgaagaagctttatggcacatcctatactctgtggaagacaaaaatgaaatagtcaaagcattacaaaaattcgccgataaacatgacttaaatgctagtttcgtagatgtcttccaaaaattcccaccctttaagaaagaatacggatcatattccgcaaaagcaatcaaaaaacttttacctttaatgcggatgggaaaatattggagcgaaaactccatagataaaggtacacgggaaagaatcgacaaaattataacaggagagtacgacgaaaagatagaaaatcgtgtacgagaaaaagcaatacacttagcagacgtctcagactttaagggattaccactgtggttagtttgctatatcgtatacggaaggcatagtgaggcaaaagaaattacacaatggaaatcaccagcggacattgactcatatctgcggtcattcaaacaacacagtctcagaaatccgattgtcgaacagataataattgaaactctccgagtagtacgagacatctggaaacaagtaggtaatatcgacgaaatccacgtcgagctggggcgtgaaatgaaaaaccccgctgataagcgaaaaaaaatgacacagcagatgagtgagaacgaaaatacaaatctccgaataaaataccttctaacagagttcctaaatcctgaatatgaggtcgaaaacgtacgaccgtattcaccaagccaacaagatatcctaagaatttatgaagagggagtcctaaacagcgtttccgatctaccagaggaaatctcagatatactaaaaaagtttacagaaacagacctaaaaaaaagaccctctagatccgagattctaagatacaaattatggttggaacagaaataccggtcgccttacacaggtgaagttataccattaggaaaactattcactccagcatacgaaatagaacatgtcataccccaatcctgctattttgacgactcatttagtaacaaagtaatatgtgaggccgaagtcaacaaactaaaaagtaacctcctaggacatgaattcattgttaaacaccatggagaaattgtcgaattaccattcggcaaaaaggtcagaatctttacagtagacgaatacgaacaattcgtaaaagacaattacagcagaaccagaagcaagatgaaaaaacttcttatggatgacattccggaggaatttgttacaaggcaattaaatgactcgagatatatctcaaaagtagtaaagtccctattaagcaacatagtaagagaaaaaggagaagaagaagccataagcaagaacgttataccctgtacaggtggagtaactgaccgactgaagaaagactggggaattaatgaagtatggaacaaaataattctccctcggttccaacgactaaacgaactaacaggtacaaataaatttacaacaaaaaatgtcggaatacaagaaatcccaaccatgccattagaactacagaagggattcaacaaaaaacgaatagatcatcgtcaccatgcaatggatgcaattataatagcatgcgcaaaccgaaatataataaactacttaaacaacgagtctgcaacagcaaaagcggaattatcaagatacgatttacaaaagatgctatgtgacaaagccaaaacggataacaatggtaattacaaatgggtaatccgcaaaccatgggcttcgttcacccaagatacatatctagcattggagaacataatagtatcattcaagcaaaacttacgcgtaataaataaagcaacaaacagatttctgcactacaacgaggaaggaaagaaaatattcgtaaaacaaggaaaaggagataattgggccataagaaaaagtatgcacaaagacacagttttcggagaagtaaacctgagacgaattaagacagtcgcactaaacgaagccatgaaaaatccacaatctattgtagttaaagactttaaacgaaaattacttgaactatggaatttagggttcgacgccaaacgaatcaaaaaatatttcgaagacaatcgcgaaacttggtctgatatcaatcttagtaaaatcgaagtttactatttcagtaaagacacaaaagatagattttttgccaccagaaagccgttagacacctcatttgatagaaaaaaaatagaaaacaacataacggacaccggtattcaaaagatacttctaagacatctagaattgaaagacaacaatccagatatagcattctctccagatggaatagacgaaatgaatagaaacattatacaactaaataatggaaagtaccaccaacccataataaagatacgatggtacgaacaagcagataaatttgccgtcggtcaaactggaaataaattttcgaaatttgtagaagcagcaaagggtaccaatttattttttgcagtctatgaaagcaacatattggataaaaaaacgaacactattataaaaaaaagaaattacgcaacaataccactcaatgtcgccatcgaaaggcaaaaacaaggacttcccgttgccccagaagatgaaaatggaaatgaccccatatttgtactatcaccaaacgaccttgtctatctacccacagatgacgagctagcaaatggtataatagcacagccactcgacaggggacgaatatataaaatggtatcctgtacaggtaatgaaggacattttataccagcgcgaatcgcaaacccaattctgcaaacaatagaactgggtagcaataataaagcacagaaagcatggaccgatgaaatgattaaagaaatatgcatgccgatcaaagtcgacagacttgggaatgtactagaatcatcatcaagctataaaaaatga

SEQ ID NO: 9221 - RNA, 4521 nt, synthetic construct
  misc_feature 1..4521: note = Cas9 variant
  source 1..4521: mol_type = other RNA
atgaagaccatattaggcttagacttaggtccaaacagtataggttgggccaaagtagaagtagacgatgagggtaactatcttagaaacataaaattaggatcgaggataattcccatgactcaagacatgctcggcgatttcgacaaaggagtcaaagtaagccaaacagccatacgaacagacttccgcggaaatagaagacttattgagcgtcacttattaagaagagagagattgcacagagtattacacgcactcaagttcctccctaaacattatgaagacgcgattggttgggaccgcaatgaaccagccacttatggaaaattcgtgaataactctgaacctaaactcgcttgggaaagacaagaagatggtagtatgagatttttgttcatggaaagttttaacgaaatggtagcagatttcgctcagaatcaacctagccttgtatccgacgggaaaaaaatccctcttgactggacaatctattacctaagaaaaaaggcccttacgagacccattaaaaaggaagagctagcttggatcttactcaatttcaatcaaaaaagaggctactaccaattaagaggagaagaagaggaggacaatctcacaaaaagaaaagaatattataaattaaaagtagtcggagtagaagcagatggcgctccaaaaggaggaaagacctggtacaatatccatttggaaaatggatggactgctcgctgtcaatcaaagattccactcgacgactgggtaggaaaagtaaaagaatatatagtaacaacagaatatgaggatgacggcaaaactccaaaatgcgacaaagaaggtaaagtgaaacgaagctttaaaagtccagaaaaagacgactggcaattaattaaaacaaggacggaaaaattcatagatgactcaaacaaaacagtaggcgcatttatctacgattacttattagaaaaaccattcgataaaataagaggtaaatatataagaacgatagaacgcaaatattataagaatgaacttcgcgaaatcttgagagaacaaacgaaatatcacgaaggactacattctctagaagcattaaaaatctgtgcagaagagttatataaaaacaaccaacaacaccaagagtatctgttaaaaaaagatatgacgtttttattactaaatgatctcatcttttaccaaagaccactaaaatccaaaaaatccttgatagctgactgtccatatgaagtatacaaatacgacgataaactcaccggaaaaaaaggccaaaaaaaaataaagtgtatagccaaatccaacccttactaccaagaattcagattatggcaattcatagctaatctcagattattttcagtaacagatggtaaggaagtaactgcagaatacctcaaaacagaagaggattacgttagattattttcattcttaaacgacagaaaagatataaaacaagaaacttttctacgaagttttctgaaactgaaaaaagaaagtattggctcagaaaaaatatatccaataagatggaactatatagaagatgcaaataaatcgtacccgtgcaacgcaaccagacacgaactcctactagcatttgaccgcgctgacataccaagagaattattagacgtagaagaaagagaatatagattgtggcacttactctacagtatagaagccaaagaagaaactgaaagtgctctaagaaagctcaaagcaaacaaagccttcggcgacctcaatattgatgatgctttcgtaaatagctttttgaaaataaaaccctttgaaaaagaatatggtgcatattcagaaaaagcaattaaaaaactattagctgtaatgaggagaggatccctatggaaagaagccgacatatgcgaagcgactaaacaaaatatagccaaaatactccaaaatgatatagatgaaaaactgaagaaaaaaatagaagctgctgtctcaagttttaacaaactctctgacttccaaggcttacccacatggctcgcatgctatgtagtatatggtcgacactctgaagcagcccaaatacagtgttggcaaagtccagaagatctaaaaacatacataaacaaattcaaacaacactcattaagaaacccaatcgttgaacaatgtctattagaaaccttacgcacagtatacgatatttggaaagacgctggacagatagacgaaatacacattgaattaggtagaaacatgaaatcaacagcagagcaaagagcgcgaaaaactaaagatattttacgaaacgagaacacgaatcttagaataaaaaatctactagtagaactaaaaaacgacgataagattgaaaacgttcgaccatattcaccatcacaacaagaaatattacggatatacgaagaaggagctttacaggaactgagcaaagaagatgagatgttcgaagatataagtaaaatttcaaaaatggctcaaccttccccgaccgaactatcaagatacaaattgtggttagaacaaaagtacagatcaccctacacaggaagagtcattcctctaagtaaactattcactaccgcgtaccaaatagagcacataataccacaaagtaggtacttcgatgattctttcaacaacaaggtaatttgcgaaagtgaagttaactctctaaaagataatatgctgggttacgaattcatcaaagaatgcggtggaagaatcgtacactgtacactactaggcgacgttaaaatatttacaaaagaagaatacaaagactttgtgacgaaacattatatagacaatacttataaacgagacaaactcctactagaagatatcccgcaagaattttccgcgagacaactcaatgactcaagatacatatcaaaaatggtccagacagtgcttagcaacattgtacgagccgaaaatgaacaagaagccaccagtaaattcgtggtatcttgcaacggagcaataactaacagactgaaaaaagattggggattgaacgatgtctggagctctatagtatgtccaagatttaaacgattaaatgaaataacaaaaactaacgcatttggccattgggaggacaaagctggaaaacatgtattccaaacaactgtccccctagaattacaaaggggattttcaaaaaaaagaatcgaccaccgacaccacgcgatggacgcgttagtaattgcatgtgcttccagaaatatagtaaactatttaaataacgagtcagccaatagtcctgagaaaagagaagatctacgaaagaaattatgtgatgaaaaacgaaaaataagaaaaccatggaagactttcactcaagatgcacgagaagcactaagtgacgtagtagtctcgttcaaaaattatgtgcgcgtaataaacaaggcgacaaattactacgagcattattcatcatctggcaacaaagtaatgatatcacaaaaaggcaacgacatgtgggccataagaaaaccactgcacaaagaatccgtttttggacgggtaaatttatgcaggaaagtgatagtttcattaaaaaaagccctagaaaacatacctgcaatatgtgacaagacactacgagattatataaacgctctagtagagaagcatttcaacaccagacaactgctagcacactttaagtcaataaactatcgccttaatagacaatgtgtcgaaaaagtagaagtctggcaatttagtgatgagaaaatagaaatggtagccagacgaaaaagtctagacacctcctttgacgataaacaaatcagttcaataacagatactggaatccaaaaaatactactcaactacttacaaacgaaagacggtaacgcggaaatagcgtttactccagagggaatagaggagatgaataaaaatatatcactatacaatgacggaaaggcccaccaaccaatactcaaagtccgcgtcgcaaccccaaaaggaatgaaataccccgtaggacaaacaggcaacaaggcaacaaaattcgtcgtagcagaaaaaggaacaaacttatacttcgcaatatatgaaaacgaattaggagttcgctcctatgacacaataccactcaacatagtagttgaaagacttaaagaaggcttgtcacccgtaccgcaagcaaacgaagccgacatacccttgaaattttatttatctcccaatgatctggtgtacgtcccaacaaaagaaaatgaagatgagttatgtagagatagaatatacaaattcgtagactcatccggcaccaccgcgaacttcgtcccacatacgtcggcaaacacaatctataatgtagacaaagagtacgctgaaaaatgctgcaacggagccgtatttctaaacgagtacgggttaggctcgcctcaatctaaaaatcagagagcgctaacaggtgagatgataaaagaaatttgttggaagctaaaagtagatcgactagggaatataataaaagtgattaaatga

SEQ ID NO: 9222 - RNA, 4530 nt, synthetic construct
  misc_feature 1..4530: note = Cas9 variant
  source 1..4530: mol_type = other RNA
atgaaaaatattgttggattagacctaggtacaaactctataggatgggccgtcgtaaacggatcagtaaacgatgacggatcggaacaattagtcaaaattcaagcaagtggctctcgaattataccaatggacgccgcaatgataggcgattttaataaagggaatagtatttcacaaaccgcagaacgaactagattacgcggagttagaagattatcagaacgatacttattaagacgcgaaagactacacagaattctcgacattctgggctttttaccattccattttgcacaagatctggatagacacggaaaaatcgtaaaaggtaaagaacccaaacttgcatggagaaaaaatgaagctggacagttcgaatttatctttcaagattcatttaaagaaatgctagaagactttaagctgaatcatccaaacttaataacagacgacaaaaaagttccgtatgattggaccatatactatttaagaaaaaaaggattaacttcaaaaatatccaaagaagaattagcatggatactgttaaacttcaaccaaaaaagaggttattaccaattaagaggagaagaagaaaaaaagaacgataatgtaatgattataaactcaaaagtaatagatgtcgtaaaagcagaaaaagacaaaaaatacgaaaaatattggtataatgttctgctagaaaatgggttactttaccgcgccgcattctacaacgatataagcttttggaaaggccacacaaaagaatttgtattaaaaaccattaagctaaagtcaggcggcacaaagcaagaactaagtttcctaccctcattcgacgaaatagagaaaatggaaaagaaacaaaaagacaaaatgtactttaaaataaagttaaaaactgaggcagatattgaccaagcacataaaaccgtgggaacgtacatctatgacaccttacttggaaacccaagccagaaaataagaggaagactagtacgaaccatagaacgaaaatattacaaagaagaattaaaattgatacttgataaacaaaaggagtttcatccagaactgcaggacagagcactatatgccgcctgcattgaagaactttatccaattaatgaagcccacagaaacaacgtaggaaatcgagacttcacatacctattcctagaagatatcttattctaccaaagaccactaaaatcaaaaaaatcacttatcgacaactgcccatatgaagaaaatcaaggactagacaaagaaacaggagaaatcaagagttttccggttaaatgtatagctaaatctcacccattatttcaagagttccgcttgtggcaattcatagtaaacttacgtatataccggaaagatttggcccaagatgtagatgtcacaaacgagctcttaaaaacagaagaagattatgttgcactcttcgactggttaaacggtaaaaaagaaatagatcaaaaagcgttcttaaaatatccggtattcggtttaaaaaaagaaattgaaaactatcgttggaactatgtacaagataaaccatatccgtgcaatgaaaccaggcttcttatgctagcaaggttagaaaaatgcgacattagcatagaattcctgacaaaggagaacgaagaagcattgtggcacatattatattcagtagaagataagaacgaaatagtaaaagctttacaaaaattcgctgataaacacgacctcaatgcatctttcgtcgatgtttttagaaagtttcctcccttcaaaaaagaatatggttcatactctgctaaagcgataaaaaaattattaccattaatgaggatgggaaaatattggtcggaggactccatcgacaaagggacaagaaaacgcatggacaaaataataacaggagagtacgatgaaaaaatagaaaacagagtaagagagaaagtaatccatttagccgacgtaagcgacttcaggggcttaccactatggttagtatgttacatagtatatggccgacattctgaagcaaaagagataactcagtggaaatcgccagcagatatagattcatacctaaaatcgtttaaacaacacagtctacgcaaccccatagtcgaacaaatcatcatagaaactcttagggtggtacgagacatatggaaacaagtaggaaatatagatgaaatacacgtcgaactaggacgagagatgaaaaacccagctgacaaacgaaaaaaaatgacacaacagatgtcagaaaatgaaaacacaaatctgcgaatcaagtatttattgactgaattcctaaatcccgaatacgaagtagaaaacgtcagaccatacagtccatcacaacaagacatactaagaatctatgaagaaggcgtacttaacagcgtttccgacttacccgaagaaatcagcgacattctaaaaaaatttaccgaaacagacttaaaaaaaagaccttcaagaagtgaaatattaagatataaactttggttagaacaaaaatatagaagcccatatacaggagaagtaatacctctaggaaagttattcactccagcttacgaaatagaacatgtcataccccaaagctgctatttcgacgacagtttcagtaataaagtcatctgcgaggcagaagttaataagctaaaatctaatttgctaggacatgaatttatagtcaaacatcatggtgaaatagtcgagctaccatttggcaaaaaagttagaatattcacagttgatgaatacgaacagtttgtaaaagacaactatagccgcacaagaggtaaaatgaaaaaattactaatggatgatatacctgaagaattcgtcgcaagacaactaaatgattcgagatatataagcaaagtagtaaaatcactgctatctaatatagtgagagaaaagggagaggaagaggcaataagcaaaaacgtaataccctgtactggcggagtaacagacagactaaaaaaagattggggtataaacgaagtctggaacaaaattatattaccacgatttcaacgattaaacgaactaacgggaacgaataagttcacaactaaaaacgtagggatacaagaaatacctactatgccattagagctccaaaaaggattcaataaaaaaaggatagaccaccgtcaccatgcaatggatgctattataatagcctgcgctaatcgaaatatcatcaactatctcaacaatgaatctgcaacggcgaaagccgaattaagcagatatgacttacaaaaattactctgcgataaagcaaaaactgataataacggaaattacaaatgggtaattagaaaaccatgggcatcattcacacaagatacctacctcgcattagaaaacataatagtatcctttaaacaaaacctacgcgtaattaataaagcgacaaatagattcctccattataatgaagaaggaaaaaagatattcgtaaaacaaggaaaaggtgacaattgggcaattagaaaatcaatgcacaaagacacagtatttggtgaggtaaatctaagacgcataaaaacagtcgcactaaatgaggcaatgaaaaatccacaatcaatagtcgtgaaagattttaaaaggaaactcctagaactctggaatctcggattcgacgcaaaaagaataaagaagtatttcgaggacaatcgtgaaacatggagtgatataaacttatcaaaaatcgaagtatattacttttcaaaagatacgaaggatcgtttttttgctacgagaaaaccattggatacatcttttgatagaaagaaaattgaaaataacataactgatacaggtatccaaaaaatactgttaagacacctagaacttaaagataacaacccagacatagcattttcaccagatggtatagacgaaatgaacagaaacatcatacaactaaataacggaaaatatcatcaacccataataaaaataagatggtacgaacaagcggataaatttgctgtaggacaaaccgggaacaaattttctaagttcgtagaagcagcaaagggcaccaatctttttttcgcagtatacgaatcaaatatattggataaaaaaacgaacacaataataaaaaaaagaaactatgccacaatcccactaaacgtcgcaatagaacgtcaaaaacagggactcccggtagcccctgaggacgaaaatggaaatgaccccatcttcgtccttagccccaatgacctagtatatctccccacagatgatgaactggccaacggaataatagcccaacctctcgatagggggagaatttataaaatggttagctgcactggaaatgaaggccacttcataccagcacgtatagctaacccaatactccagaccatagaattaggctcgaacaataaagcgcaaaaagcatggacagacgagatgataaaagaaatatgtatgcccataaaagtcgaccgtttgggcaacgtattagaatcatccagctcttataaaaagtga

SEQ ID NO: 9223 - RNA, 4530 nt, synthetic construct
  misc_feature 1..4530: note = Cas9 variant
  source 1..4530: mol_type = other RNA
atgaaacgaattctcggactggacctgggcaccaatagtatcggatggagtctaatagaacatgatttcaaaaacaagcaaggccaaatcgaagggctcggcgttcgaataatacctatgtcgcaagaaatactaggaaaatttgacgcaggacaatcaatatcacaaacagcagatagaacgaaatacagaggagtacgaagactctaccaaagagacaaccttaggagagaaagactacacagagtactaaaaatcctcgattttttaccgaaacactactcggaatcaatcgatttccaagacaaagttggtcaatttaaaccgaaacaggaagtaaaacttaattatagaaagaacgaaaaaaacaaacatgaatttgtcttcatgaattcatttatagaaatggttagcgaattcaaaaacgcacagcccgagctcttttataataaaggcaatggagaggagaccaaaattccatatgattggacactctattaccttcgaaaaaaagcactaactcaacaaataaccaaagaagaactagcatggctcatactaaattttaaccaaaaaagaggatactatcagttgcgaggagaagatatcgacgaagataaaaacaaaaaatacatgcaactaaaagtaaataaccttatcgatagcggagctaaagtcaaaggcaaagtcctctataacgttatattcgataacggttggaagtacgaaaagcagatcgttaataaagacgagtgggaaggccgaaccaaggaatttatcataacaacgaaaacacttaaaaatggaaatataaaaaggacatataaagccgtagacagcgaaattgactgggcagcgataaaggcaaagaccgaacaagacattaacaaagccaataagacggttggagaatacatatacgagtctctactggataaccccagccaaaaaataagaggaaaattggtcaaaacaatcgaaagaaagttttacaaagaagaattcgaaaaactattatcaaaacaaatagaactacaaccagaattattcaatgagtcgttgtataaagcgtgcataaaagagctatacccgcgaaatgaaaatcatcaatctaacaataaaaaacaaggattcgaatacctatttacagaagacattatattctaccaaaggccattaaaaagccaaaaatctaatatatccgggtgccaatttgaacacaaaatctacaaacaaaaaaataaaaaaactggaaaattagaattaatcaaagaaccaatcaaaaccatatcaagatcccatcccctcttccaagaatttagaatttggcaatggttacaaaatttgaaaatatataacaaagaaaaaattgaaaacggaaaactagaggacgtaacaacccaacttcttccaaacaatgaggcatacgtaacactcttcgactttctaaacacaaaaaaagaactcgaacaaaaacaattcattgaatacttcgttaaaaagaaactaatagataaaaaagaaaaagaacactttaggtggaactttgtagaagataaaaaatacccattctctgaaactagagcccaattcttgagtagattagcaaaagttaaaggtattaaaaacacggaagattttttaaacaaaaatacgcaagttggaagcaaagagaactcaccattcataaaaagaatagaacaactatggcacataatttacagtgtatccgatctaaaagaatacgaaaaagctttagaaaaattcgcagaaaaacataatttagaaaaggacagtttcctaaaaaactttaaaaaattcccccctttcgtaagcgactatgcctcatactcaaaaaaagctataagcaaattattgccgataatgagaatgggcaaatattggtcagaaagtgcagtcccaacgcaggtcaaagaaagatcattatcaataatggaaagagttaaagtcctaccattaaaagaaggatactccgataaagatttggcagatctcttatctagagtatcagacgatgatattcccaaacaactaatcaaatcgttcattagtttcaaagataaaaatcctttaaagggcttaaatacttaccaagcgaactacctagtttatggcagacattctgaaaccggagacatacaacactggaaaacaccagaagatatcgaccgatatctcaacaacttcaaacaacacagtctaaggaacccaatcgtagagcaagtagtaatggaaacactaagggtggtaagagatatatgggaacactatggaaacaacgaaaaagactttttcaaagaaatccatgtagagcttggtagggaaatgaaatcgcccgcaggaaaacgcgaaaaactctcacaacgcaacacagaaaacgaaaataccaatcataggatacgcgaagtattaaaagagctaatgaatgatgctagcgtagagggaggggtaagagactacagtccatcgcaacaggaaatccttaaattatacgaagaaggtatctaccaaaatcctaatacaaattatctaaaagtagatgaagacgaaatcttaaaaataaggaaaaagaataatccgactcagaaagaaatccaacgatacaaactatggttggaacaaggctacatcagtccctacactggaaaaattatcccgctcacaaaattatttacacacgaatatcaaattgagcacataataccacaatctcgctactacgacaatagcctaggcaacaaaataatatgcgagtcagaagtgaatgaagacaaagataacaaaaccgcatacgaatacctgaaggtggaaaaaggatcaatagttttcggtcataaactattaaatctcgacgaatatgaagctcacgtaaataagtacttcaagaaaaacaaaacaaaactaaaaaacttactatcagaagacatacctgaaggattcataaatagacaattaaacgactcacgatatatctcaaaattagttaagggactcttatcaaacattgttcgagaaaacggagaacaagaagcaacatcaaagaacttaatacccgttacaggagtagtaacatccaagcttaaacaggactggggactgaacgataaatggaacgaaataatagcaccgagattcaaacgactaaacaaactaacaaactcaaatgacttcggattctgggataatgacattaacgccttccgaatacaagtcccagattcactaataaaaggttttagcaaaaaaagaatcgatcatagacatcacgcactcgacgcactagtagtagcatgtacatctaggaaccatacacactacttgagcgcattgaacgccgaaaacaaaaactacagcttaagagacaaactagtcattaaaaacgaaaatggcgactacacaaaaacgttccaaataccgtggcaaggattcaccatcgaagccaaaaacaacttagaaaaaacagttgtaagtttcaaaaaaaacctaagagtgatcaataaaaccaataataaattctggagctataaagacgaaaacggcaacctaaatttaggaaaagatgggaaacctaaaaaaaaactaagaaagcagacaaaaggatacaactgggcaattcgcaaaccacttcataaggaaacagtctcaggtatatacaacataaatgccccaaagaacaaaatagctacatcagtccgtacactcttaactgaaataaaaaatgaaaagcacctagccaaaataactgacttgagaatcagagaaacaatattacccaaccacctaaaacactacctaaataataaaggcgaagcaaacttctccgaagcattctcacaaggaggtatagaggacttaaataaaaaaataaccacactaaatgaaggcaaaaaacatcaaccaatatatcgagtaaaaattttcgaagtgggcagcaaattctcgatatccgaagatgaaaacagtgcgaaatcaaaaaaatatgtagaagcagcaaagggtaccaatcttttcttcgcgatttatttagacgaagaaaacaaaaagaggaattatgaaacaattccacttaacgaagtgattacccatcaaaaacaagtagccggtttccctaaaagcgagaggctctcagtgcaaccagattcacaaaaaggtaccttcctcttcacattaagtcctaacgacctcgtatatgtaccaaataacgaagaactcgagaaccgagacctttttaacctaggtaatctaaatgtagagcaaatcagcagaatatataaattcactgattcatccgataaaacatgcaattttattccatttcaagtctccaaactcatctttaatctaaagaaaaaagaacaaaagaaactcgatgtcgactttataatccaaaacgaattcggtttaggatctccacagagtaaaaatcaaaaatctatagatgatgtaatgataaaagaaaaatgcatcaaattaaaaatagacagactaggtaacatatcaaaagcatga

SEQ ID NO: 9224 - RNA, 4530 nt, synthetic construct
  misc_feature 1..4530: note = Cas9 variant
  source 1..4530: mol_type = other RNA
atgaaaacgattctaggcctcgatctaggtaccaattcagtagggtgggcagtaataaattctgttataaaagagcaggcagaacgtatatggatcgaaatggccggtagtagaataataccaatggatgcagcagtactaggagactttgataaaggtaattcaataagtcaaacatcagaaagaacccgattaagaggagtaagaaggctgcgagaaagacaactactaaggagggaacgtctgcataaggtactaaatatactaggcttcttacctaatcattacttagaatacatagactttgagaaacaccctggaaaattcttgagtgacgcagaacctaaactgccatgggttaaagatgagcaaggaaaatatactttcttattccaggcagcatttgatgaaatgctagcagactttgcaatacatcaaccttcgctcgtgtctggagataagaaaataccttatgattggacaatttactacctaagaaaaaaagctctaacagaaatgataagcaaagaagaactagcatggattttactaaatttcaatcaaaaacgaggctactaccaactacgaggtgaagaagaagaagataacgcaggaaaaagcgtcgaattctacgcattgaaggtattgactgttgaagcgaccgatgaaaaaaaaggaagagacgtgtggtacaatgtacacttagaaaatggatggatataccggaggagctcttctgtaccactagactgggaagggcaaattaaagaattcatcgtaaccaccgatttgaatccagactcaacacccaaattagacaaatacggagaggtaaagcgttcattcagagctccaaaggaagacgattggatgttaataaaaaaaaggaccgaggcagatattgcaaatacgcataaaaccgttggagcttacatatatgacacgttacttcagaaaccacaacaaaaaataatcggaaagttggtaaaaaccgtggaaagaaaactatatagagacgaattatcgctaatattacaaaaacaatgcgccttccatgctgaattacaagacagaacgttatacgccaggtgtgtagaggctttatatccaaacaatgaagtccagagacggaatatagcaaacagggacttcgtatacctgttaatggatgatgtattgttttatcaaagaccattaaaaacaaaaaagagcctaatagcgaactgtccatatgaagaaaatgaatacgtagatcgagaaacaggagaaatcaagaaagcaccactaaaatgcattgcgaaatcacacccactatttcaggaatttcgtctatggaacttcttaagcaatattcgaatatatcaaaaagaaaaagaaataaatgggacactacatttggatgtagacgtcacagcagagtttttgaaaacagaagacgattatgtagctctgtttgattggctaaacagcagaaaagaaatagagcaaaaaactttcctaaaatatcccaaatttggacttaaaaaagaaatatcaaattacagatggaactatgttgaagataagcaatatccctgtaatgaaactcgacatgccatattaagtaggttagaaaaagcaaacgtatgtatagatttcctatccaacgaaaaagaggtcgcactatggcacatactatattcggtaagcgacaaacaagaaatagagaaagcgttaagaacttttgcagcaaaaaacggattagatgaaagtttcgtcgaagcttttaaaaaatttcctccatttaaatcagaatacggagcatactcggccaaagccataaaaaaactactaccactaatgagatgcggaaaatattgggacgtcagtagtatagacgatacaacaaaggagagaataaaaaaaatcgtagcaggcgaatatgacgagagaatagccgttaaagtaagagataaagtcatgaatctatcagatatatcctgttttaaaagattgcccttatggttggcatgctacatagtgtacaatagacacagtgaggataaagaggctgtaaaatgggaaagccccgctgatatagatgcctaccttgcaagttttaaacaacactcactcagaaacccgatagtagaacaagtcataacagagacactgagagttgtacgagatatatggaagcaagtagggagaatagacgaaatccacatagaactcggcagagaaatgaaaaatcctgctgacaaaagaaaaagaatgacagcacaaatcttggaaaacgaaaatgcaaatctcaggatcaaagcactattggcagaattcatgaatccagaatatgaaatagaaaacgtacgaccatactctccgtcacaacaagaaatcttaagaatatatgaagatatggtgttgcacgccgaggatcaactgccagaagaaatcgatgcaatcttaaagaagtttaattcaagtaaagtaccaaccaaatcagaatttctgagatataaattatggttagagcaaaagtacagatccccatataccggggaattaatacctctaggtaaattatttacagcagcatatgaaatagaacacgttatacctcaaagtcgatatttcgatgacagtttcagcaacaaagtaatatgtgaatctgcagtcaataaactcaaagataatcaattaggttatgaatttatcaaaaaccatcatggacaaaaagttgaagtagggtttggcaaatctgtggaaatcttctcagttgatagttacgaaaggttcgttaaagagcaatacgctaaatccgccgtaaaaatgaaaaaaatgctaatggatgatatacctgaacaatttatagaaagacaactaaacgactcgagatatatatcaaaagtaatcaaaggactacttagcaatatagtaagagaaaaaaatgatagcggagaatatgaacctgaagcagtgagcaaaaacatagttgtatgcacaggatcggtgactgacaggttaaaaagagattggggaatgaacgacgtatggaactcgatagtataccccaggtttgaacgattaaacagcctaactgacacacaatcattcggacattgggaaaacaagtcaggaaaaaaagtatttcaaaccgaacttccgctcgaataccaaaaaggattctcaaagaaaagaattgatcacagacatcatgccatggatgcaatcgtgatagcctgcgccacgcgcaatcatgtaaattacctaagtaacgagtcagcaagccgaaatgctaaaataagtcggtatgacttacaaagactgctatgtgacaaatccagaacagatgacaacggtaattacaaatgggttataaaaaaaccatgggacacattcacgcaagatgcacgtgaagttctatcaaaaatagtcgtgtcacttaaacaaaacttaagaataattaacaaaacaactaatgtttacagacatttggatgcaactggcaaccgagtatatgaaaagcaaaagactggagactcttgggcaatacggaaacctatgcataaagacacagtatttggtgctgtaaatcttagaaaagttaaagtagtacgactaagtgtagcccttgacgctccaacgatgatagttgacaaacgagtaaaaaacaaagtatttgaactgctttcatacaaatatgataaaaaaagaatagaaaagtatttcaaagaaaacgccgtattatggaaagaattagacctggcacgagttgcggtttattatttcacagaggcaacaacagagccattagttgcagtaagaaaaccgctggactcgacttttaatgaaaaaaaaataaaagaatcggttacagacaccggtatacaaaaaatactactaaatcatctttgcacaaaggaaggaaaaccagacctagcattttctgcagaaggaattgaagaaatgaacagaaaccttttgcaactgaataacggaaaaagacaccagccgatatataaagtgagagtctacgaacctaggggaaacaaatttagtgtgggagtgttgggaaataaaggaactaaatgggttgaagctgcaaaaggaactaatctatttttcgcgatttatataaccgaggacgggaagagaacatacgaaactataccccttaatatggtaatcgaaagggaaaaacaaggactcgcaccagtacctgataagaacgaaaaaggagacaaactcttgttttggctaagcccaaacgacctagtatatctacctacggaagaagaattggagtttggaagaattaacgagcccattgatagaggccgcatatataaaatggttagcagttccggcaatcaatgtttttttataccccagtccataagcaacgcaattatacccacaaaagaactaggagcaaataataaggcagaaagaagctgggacggtgcaatgataaaaaatatctgtatccccgtcaaggttgatagactgggtaggatcatagaagtaaaatatagaatcaatgaatga

SEQ ID NO: 9225 - RNA, 4530 nt, synthetic construct
  misc_feature 1..4530: note = Cas9 variant
  source 1..4530: mol_type = other RNA
atgaaaacgatattagggctagacttaggcaccaattcagtaggatgggctgtaatcaactcggtaataaaagaacaagccgaacgtatatggatagaaatggcaggatctagaataataccaatggacgcggcagttctaggcgactttgataaaggtaactcaatatcacaaactagtgaaagaacacggctaagaggagcacgacgcctaagagaaagacaactgctacgccgggaaagactacataaagtactcaatattcttggcttccttcctaatcactatctcgagtacatagattttgaaaaacacccaggaaaatttcttgctgacgcagaacctaaattagcttgggtcaaagatgaacagggaaaatacacattcctcttccaggcagcctttgacgaaatgctcgctgatttcgctatccatcaaccgtccctagtctccggagacaaaaaaataccttatgactggacaatatattatctacgaaaaaaagctcttacggagatgatttctaaagaagagctagcgtggatactattgaattttaatcaaaaaagaggctactatcagttgaggggagaagaagaagaggacaatgcaggaaaatctgttgaattctacgcactaaaagtgttaacagtagaagctacagacgaaaaaaaaggacgagatgtatggtacaacgtacacctagagaacggatggatatataggagaagtagtagtgtcccattagattgggagggacaggttaaagaattcattgtaacaacagacttaaatcctgatggcacaccaaaattagacaaatatggagaagtaaaaaggtcttttagagcgccgaaagaagacgattggatgttaattaaaaaaagaacagaagcagacatagcaaatacacacaaaacagtgggagcgtatatctatgacaccctactacaaaaacctcaacaaaaaataataggcaagttagtgaaaactgtagaacgaaaactataccgcgacgaattatcattgatactacaaaaacaatgcgccttccatgcagaactgcaagacagagccctatacgctcgctgtgtagaagctttgtacccgtctaatgaagtacgaaggaaaaacatagcaaatagagattttgtgtacctcttaatggatgatatacttttctatcagagaccattaaaaacaaagaagtcattgatagcaaactgcccatacgaagaaaacgaatatgttgacagagaaaccggagaaataaagaaaacacctttaaagtgtatagccaaatcacacccgctatttcaagaattccgattatggaattttttaagtaatattcgaatatatcaaaaagaaaaagaaataaacggtaccctacatctagacgtagacgtaacagcagaattcttaaaaacagaagacgattatgtggcccttttcgattggctgaatagtagaaaggaaatcgaacaaaaaacctttttaaaatatcctaaatttgggctaaaaaaggaaatatctaactacaggtggaattatgtcgaagataaacaatatccctgtaacgaaacgcgacacgccatactgtcttccttagaaaaagctaatgtttgtatagattttctgtctaatgaaaaggaagttgctctatggcatatactctatagtgtctcagacaaacaagaaatcgaaaaagcactaagaacatttgcggcaaagaatggacttgatgaaagcttcgtcgaagcctttaaaaaattcccaccattcaaatctgagtatggagcatatagtgccaaagcaatcaaaaaaatgttacctctaatgcgctgtggaaaatactgggatgtctcaagtatcgatgatacaacgaaagaaagaatcaaaaaaatagtcactggagaatacgatgagagaatatcagtgaaagtccgagataaagtcatgaacctgtcagacataagctgttttcgccgcctacctttatggctcgcatgctatattgtatacaatagacactcagaagacaaagaagctgtgaaatgggaaagtccagccgatatagatgcatatcttgcgagttttaagcaacattcattaagaaacccgatcgtagaacaagtaattacggaaacacttcgtgtagtacgtgacatatggaaacaagtaggccgaatagatgaaatacatatagaactcgggagagaaatgaaaaaccccgctgataaacgcaaacgaatgacagctcaaatcctcgaaaacgaaaacgcaaatttacgaataaaagcacttttagctgaatttatgaacccagaatatgaaatagaaaacgtaagaccatactcaccgagccaacaagaaatacttcgaatatacgaagacacagtcctacacgcagaggatcagttaccagaagaaatagacgcgatattgaaaaagttcaattcatcaaaagtgccaacaaagtcagaatttctacgatataaattatggttagaacagaaatatagatctccctatacaggtgaattaatacccttaggcaagctgtttaccgcagcctacgaaattgagcacgtaatcccgcagtcacgctacttcgatgatagcttttccaacaaagtaatttgtgagtccgctgtaaacaaattaaaagataatcaactaggatacgagttcataaaaaatcatcacggacaaaaagtggaggtgggctttggtaagtcagtagagatatttagcgtagactcgtacgaaagatttgtaaaagaacaatatgcaaaaagtgcagtaaaaatgaaaaaacttttaatggacgatataccggaacaattcattgaacgacaactcaatgactcaagatatatctccaaagttataaaaggcctattaagcaatattgttcgagaaaaaaacgatagcggcgaatacgaacctgaagcagtatcaaaaaacattgttgtatgtacaggaagtgtgactgatcgactaaaaagggactggggtatgaatgatgtatggaacagtatcgtgtatcctagatttgaaaggctaaacagcttaacggatacacaatcatttggacattgggaaaacaaatctggcaaaaaagtattccaaactgagttaccattagaatatcagaaaggtttctccaaaaaaaggatagatcacagacaccacgcaatggatgcaatcgtaattgcatgtgcaacacgcaatcatgtcaattatttgtcaaatgaaagtgcatcaaggaatgcaaaaatatcaagatacgatttacaaagactgttatgcgacaagaatcgtacagacgataacggcaactacaagtgggtcataaaaaaaccatgggacacctttacacaggatgcgagagaagtattatctaaaatagtagtatccctaaagcaaaatttacgtataataaataaaacaacaaacgtatatagacacctcgatgctacaggaaaccgagtatatgaaaagcaaaaaactggagactcatgggccatacgaaaacctatgcacaaagataccgttttcggtgccgtcaatttaagaaaggtaaaagttgtaaggctatccgttgccttagatacgccagccatgatcgtagacaaaagagtaaaaaacaaagtctttgaactattatcctacaaatacgataaaaaaagaatcgaaaaatatttcaaggaaaacgcctttttatggaaagaactagatctcgcgaaagttgccgtgtactatttcacggaagcaacaactgagccattagtggcagtaagaaagccactagactcaacattcaacgaaaaaaaaataaaagaaagtgtaactgataccggtattcaaaaaatcttattaaatcatctttgtacaaaagaaggcaaacccgatctagccttctcagccgaaggcattgaagaaatgaaccgaaacttattacaattgaataacggcaaaagccatcaacctatctacaaagtacgtgtatatgaacccagaggaaataaattcagtgttggtgtactcggaaacaaagggaccaaatgggttgaggctgcaaaaggaacaaacctattcttcgcaatatacataacagaagatggtaaaagaacttatgaaaccatcccactaaatgtagtaatagaacgagaaaaacaaggtttagtaccagtgcctgacagaaacaagaaaggagataaacttctcttctggctaagccctaacgacctagtatacttgccaaccgaggaagaaagagaattcggaagaattaacgaaccgatagacagaggcagaatatataaaatggtgtcatgcacaggtaatgaaggacatttcatacccgcaaatgtagcaaatccaatcgttccagtgatcgaactaggatctaacaacaaagcacaaagagcttggactaacgaaatgataaaagacatttgtatcccaattaaggtcgatagactggggcacattattgaagtaaaatatagaatagatgaatga

SEQ ID NO: 9226 - RNA, 4530 nt, synthetic construct
  misc_feature 1..4530: note = Cas9 variant
  source 1..4530: mol_type = other RNA
atgaagaaaatacttggcctagacttggggaccaattcagtgggatgggcagtaataaatagcgtggtaaacgacgaaggtaaagaacaacttgtaaatatatctagctgtggaagtagaatcataccgatggatgcggcaacactaggagactttgataaaggtaactctaaatcaccagtagcagaaagaactcgactaagaggagtcagaagactcttagaaagaagtctactaagacgagaaagattacatagagttctatcagtcatgggatttctaccagaacactatgcagcgcaactcgatcggtatggtaaattccttccagaaactgaacctaaactagcctggtacaaagatgaaacaggcaaataccgatttttatttcaagattcgtttaatgaaatgttagaagattttcacgaacaccatccagaactcgtcgcagaaggaaagaaaatacactatgactggacaatatattacttaaggaaaaaggctttatcacagaaaataactaaagaagaacttgcatggatactactaaattttaaccagaaacgtggttattatcaattaagaggagaagaagaacaagaagataacaagaaatcagtagaatattacgctttgaaagtggtagcagtagaagactctggcgatagaaaaggtaaagatatttggtataatgtcaaactagaaaacggttgggtttatcgacgtgcatcaggcgtaccacttgattgggttggtaaagttaaagagttcatagtaactacagacttagacgaaaaaggcaatcccaagaaagataaagatggcaatgtgaaacgatcctttagagcaccaaaagaagatgactggggactacttaaaacaagaacacaagcacaaatcgacgaaagtggacaaacagtaggaacgtacatatacgaaagtttactgagaatgccagatcagaaaattcgagggaaattagtacggacaatagaaaggaaatattataaagatgaactaaggaaaatattgataaaacaaagtgagttccacacagcattacaagaccataatttgctactagcatgtattgaagaactttaccccaacaatgaggcacatagacgtttactaagcaccagtgattttacatactttctagtggaagacatcctattctaccaacgtcccctcaaaagccaaaaaggccaaatcgacgactgtccttacgaaagtcacgtttacagggataagaaagacggatcattacaacatgtcccactaaaatgtgtatcgaaatcacatcctcttttccaagagtttagactatggcattttcttagttttctgagaatataccaacgagagcgtatgattgatggaagtttaaaactagatgtcgacgtaacgaatgaatttttacaaaacgaggatgactatgtaaaactatttgattggctgaacgaaaggaaagaaattgaccagaaaactatattggcgtataaaccatttggcctaaagaaaaacgaacaatcaaaatatagatggaattacgtcgaagacaaatcatacccttgtaatagcacacgggctgacatgatcttcagattatcaaaagcaggagtaccagaagagttcctaacaagagaaaaagaagaagccctatggcacatattatactcgatctcagataagaaagaactcaccaaagcactcggaacatttgctgagaaaaatggattgaatgaaacattcgttgagattttctcaaaaatgccaccattcgaatccgactatgctgcatactcattgaaagctataagaaaactattagccttaatgcgtatgggaaaatattgggacgaacaagcaattgacgagcatacaagaagcagaatagagaaaatacttacaggcgaatacgatgaaacaatcagaacaagagtcagagaaaaagcgatgcatttgactgatataagcagcttcagaggcctaccgctatggctagcatgctacgtagtctacgatcgtcatagtgaagccaaagaattggtaaaatgggaaacccctgacgatatagaccactttttacgcaaatttaaacaacatagtcttagaaatccaatagtagaacaaattataatggaaaccttgagaacggtaagagatatatggaaacaagagggaaaaatcgatgagatacatgtagaactgggacgagagatgaaaaatcccgcgaaagaacgagcgagaattacagcacaagttctagaaaatgaaaacacaaatctgagaataaaagcattactagcagaatttatgaatccggagttcgaaatagaaaacgtcagaccatactctccagctcaacaagaaattctaagaatctatgaagaaggagtcctatcaggggtagcagagaaagatctacccgatgatattgcgtcaattcttaagaaatttagagaaaatgacgttaagaaacgacccacaacctcagaagtactaaggtacaaattatggctagaacaaagatatcgaagtccatatactggacgaattataccacttggcaaattatttactcccgcttacgaaattgaacacgtaatacctcaatcgaggtatttcgacgactcattcacaaacaaagtcatatgtgaaagtgcagtaaacaaattaaaagacaactgtctaggctacgagtttgtcaagaaacattctggagaaaaagtagagctaggaaatggagagacagccacaatcttctcagttgaagaatacgaacgatttgttaaagatagttactttaacaacagcaagaaaatcaagaaactattgctagaagatataccagacaattttatagaaagacaactaaacgactcacgatacatatcaaaagtggtaaaatcgctactgtcaaatatagtttgtgaagaaggtgaacaagaaggtatgtctaagaacgtaatagtctgtacaggaggtgtcacagacaggctaaagaaagattggggagttcaagacgtctggaaccggataattttacctagattcttacgtctaaataaaatgaccgacagaacagactttacagcagtaagcacaaacggacatcttttaccggcggtaccgctacatttacaaaaaggatttaataaaaagagaatcgaccacagacaccatgctatggatgcaatagtaatagcctgtgcaggaagaaatatagtaaattatctgaacaacgcaagcgcacgaaaagggagcgagatctcaagatatgatttgcagcaccttctatgcgataaagttaagacagacgcgaatggcaactataaatggatacttcgaaagccctgggaaacttttacccaagatctatatgcggcacttacaaacatagttgtatcattcaaacaaaacctcagagtcataaacagaactacaaaccattatcaacactacaatgaagatggagagaaaaagatgataccacaaaccaaaggggacagattagccataagaaaacccatgcacaaagatactgtgtacggtgaagtaaacttaagaaaagagaaaactctaccgttaaaggatgtagtcaaaaatccaagcgccgtagttgataaatcactcaaaaacaaactatatgaattattaaaatcacaatacgacctaaaagcaataacaaaatactttgaaacccaccaagatgtatgggccgatgtaaacttaaagaaaataaaagtttattactttaccaaagaaacgaacgaaagatttttcgctactagaaagagcttagattcttctttcagccagaagaaaatagaagaagaagtaactgatactggaatacagaaaatcctattaagacatctgcaacaaaatggcaataatccagacattgctttttcaccagacggtgtagaaagaatgaaccaaaacatgacaatacttaacgacggtaaatggcatcaaccaatatataaggtacgcacatatgaaaaggctgacaaattcgcagtaggagaaaaaggaaacaaagtaaagaaatttgtggaagcagctaaggggacaaacttattctttgcggtttatgagagtatacaggaagacgaggcgacaggcaaacaggtaagaaaacgaacatttgctaccataccactcaatgaagttattaaaaggaagaaacaagggttaccagcagcacccgaagatagtaaaggcaatcttcccatctttgttctgtcaccgaacgacttagtgtacctcccaacagaagaagaaagaaatagtggaaaaataattcaaccgctagatcgtgaaagaatttataaaatggtaagttgtaccgaaggagaatgtcattgcatacctgaatacgtagcaaatccaatcctccaaacaatagaactcggctccaataataaagcccaacgcgcctggagtggtgaaatgataaaagaaatatgtgtacccgtaaaagtggaccgactaggtaatgtttcattaattaaaatatga

SEQ ID NO: 9227 - RNA, 4530 nt, synthetic construct
  misc_feature 1..4530: note = Cas9 variant
  source 1..4530: mol_type = other RNA
atgaaaactatcttaggtctagatctcggtaccaactcagtgggatgggccgtaataaactcagtaatcaaagaacaagcagaaagaatttggatagagaccgcaggaagtagaatcatacccatggacgcagcggttttaggagacttcgacaaaggaaacagcatatctcaaacatccgaacgaaccagattacgtggagcaagaagactcagggaacgacaattactacgtagggaaagattgcacaaagttctaaatatacttggatttcttccaaatcattacttagaatatattgattttgaaaaacacccaggaaaatttcttgccgatgcagaaccaaaattggcttgggttaaagacgaacaaggaaaatacacatttttatttcaggccgcatttgacgaaatgcttgcagactttgccatacaccaaccatcattagtaagcggagacaagaaaataccatatgactggacaatttactatcttagaaagaaagctttgaccgaaatgataagcaaagaggaacttgcatggatattactaaatttcaatcaaaaaaggggttattatcaactaagaggtgaggaagaagaagacaacgcgggaaaatcagttgaattctacgcacttaaagtattaacggtggaggccacagatgaaaaaaaaggcagagatgtttggtataatgtacatttagaaaacgggtggatatacagaagaagcagctccgtaccattggactgggaaggacaagtcaaagaattcatagtgacaactgacttaaacccagacgggactcctaagctagataaatatggtgaagtaaaaagatcattccgcgcaccgaaagaagatgattggatgctaataaaaaaacgaacagaagcagatattgcaaacacccataaaacagtaggagcgtatatatatgatacactattacaaaaacctcaacaaaaaataatcggaaagttagtaaaaacagtcgaacgcaaattatatagagacgagctctctctcatacttcaaaaacagtgtgcttttcacgcagaactacaagacagggctctctatgcgcgatgtgtcgaagccctctacccaagcaacgaagtaagaagaaaaaatatagcaaatcgtgacttcgtgtacttattaatggatgatattttattctatcaaagaccactaaaaacaaagaagtcactaatcgcgaactgcccttatgaagagaatgaatatgtagacagagaaactggagagataaaaaaagctccactcaaatgcattgcgaaatcacacccactatttcaggaattccgtctatggaattttttaagcaacatcagaatttatcaaaaagaaaaagaaataaatggaacgctccatctcgacgttgacgtaacagctgagttcctgaaaaccgaggatgattatgtagcactatttgactggttgaactcaagaaaagaaatcgaacagaaaacctttttaaaatacccaaaatttggactcaaaaaagaaatcagtaactacagatggaattacgtggaagataaacaatacccatgcaatgaaactcgacatgctatattgagttcactagaaaaagcaaacgtttgtatcgacttcctttcaaatgaaaaagaagtggctttatggcacatactatactctgtatcggacaaacaggaaatcgagaaagcgctaaggactttcgcagcaaaaaatgggttggatgaatcttttgttgaagcgtttaagaaattccccccttttaaatccgaatatggagcatactcagctaaagctataaaaaaaatgctaccgcttatgcgttgtggaaaatactgggatgtaagttcgatcgatgatacaaccaaagaaaggatcaaaaaaatagtcaccggagaatatgatgaaagaattgccgtaaaagtacgggacaaagtaatgaatctgtccgacatatcatgttttagaagattaccactatggttagcgtgctacatagtatataacagacactcagaagataaagaagccgtcaaatgggaaagcccggctgacatcgatgcatatttagcgagctttaaacaacattccctgagaaatccaattgtagaacaggttataacagagacattaagagtagttagagatatttggaaacaagtaggaagaatagacgaaatacatatagaactgggaagggaaatgaaaaatccagcggataaacgaaaaagaatgacagcccaaatactagaaaacgaaaacgcaaatttaagaatcaaagcgctcttggcagaatttatgaatcccgagtatgaaatcgaaaacgttagaccctattcaccgagccaacaagaaattcttcgtatatacgaagatacagtcctacatgcggaagatcaattaccagaagagatagatgctatactaaaaaaatttaatagtagtaaagtaccaacaaaaagtgaattcctaagatacaaattatggttagaacaaaaatataggtcaccatacacaggagaattaataccactaggaaagctgttcacggcggcctacgaaatagaacacgtaattccacagtcaagatatttcgatgactcattcagcaataaagtcatatgcgaatcagcagtaaacaagttaaaagacaatcaattaggttacgaattcatcaaaaatcatcatggacaaaaagtcgaagtaggattcggtaaaagcgtagagatattctcagtagattcatacgagaggttcgtaaaagaacaatacgcaaaatcagccgtaaagatgaagaaactactaatggatgacattcctgaacaattcatagaacgacaactcaacgacagtaggtatatatcaaaagtaatcaaaggacttttatctaacattgtaagagaaaagaacgattctggagaatatgagccagaagccgttagtaaaaacatcgtagtttgcactggcagcgtgaccgatagactaaaacgagattggggtatgaacgacgtctggaattccattgtctatccgagattcgaacgcttaaactccctgaccgatacacagagttttggtcattgggaaaataaatctggaaaaaaagtttttcaaactgagttaccgctagagtatcaaaaagggtttagtaaaaaacgcatagaccacagacatcatgcaatggatgctatagtaatagcatgtgcgaccaggaaccatgtcaattatttatctaatgagagcgcttcccgaaatgcaaagataagccgatacgacctacagagactactttgtgataaaaacagaactgacgacaatggcaattacaaatgggtcataaaaaaaccctgggacacattcactcaagatgcacgagaggtcttatctaaaattgtggtaagtctaaaacagaatctacgaataataaataaaacaacgaacgtatatcggcacttcgatgctacagttaacagagtatacgaaaaacagaaaacaggagacagttgggcaatcagaaaacctatgcataaagatacagtcttcggagcggtaaatttacgaaaagtaaaagtggtcaggttaagcgtagctttagatacaccggccatgattgtagacaaaagagtaaaaaacaaggttttcgaactactatcatataaatatgataaaaaacgaatagaaaaatactttaaagaaaacgcattcttatggaaggaacttgatttagccaaagtcgcagtatactacttcacagaagcaacaacagaacctttagtagcagtaagaaaaccactagacagcacctttaatgaaaaaaagattaaggaatcagtcacagataccggaatacaaaagatattattaaaccatttatgtacaaaagaaggaaagcccgatttagcattttctgcagaaggtatcgaagaaatgaataggaacttgctacaactcaacaatggaaaaagccaccaaccaatctacaaggtaagggtatacgaacctcggggaaacaaattcagtgtaggagtcctcggaaataaaggaacaaaatgggtagaagcagcaaaaggaactaacctattcttcgctatctacataacagaagacggaaagcgaacatatgaaacaatacccctgaatgtagttatcgaacgagaaaaacaaggattagtacccgtcccagacagaaacgaaaaaggggacaaactactcttctggctatcacccaatgatcttgtttacctcccaactgaagaagaaagagaattcggaagaataaacgaaccaattgacagaggacgcatatataaaatggtaagctgtactggaaatgaaggacatttcataccggcaaatgtagcaaaccctattgtacctgtaatagaacttggatccaacaataaagcacagagagcatggaccaacgaaatgattaaagacatttgcataccaataaaagttgatagacttggacacataattgaagtcaaatatagaattgacgaatga

SEQ ID NO: 9228 - RNA, 4530 nt, synthetic construct
  misc_feature 1..4530: note = Cas9 variant
  source 1..4530: mol_type = other RNA
atgaagaaaactctaggattagatttaggaacaaattcaataggttgggcagtaataaactcaaatatagactcggaaggtaaagaaaaactggtaggcatctcatcctgtggatcgagaataataccaatggatgcaaccactctaggcgacttcggtaaaggaaatacaaaatccccagtagccgaaagaaccagactaagaggtataaggaggctactagaaagatcattacttagaagagaaagattacaccgagtattaagtgtaatgggctttctgccagaacactacgcatcacaattagacagatatggaaaatttctacctgaaacagaacccaaacttgcatggtacaaagacgattcaggccgataccaattcttatttcagaaaagttttcacgaaatgttagaagatttccgccaacaccaacctgagctagtagccggggaaaagaaaattccgtatgactggacgatatattacttaaggaagaaagccctgtctcaagaaataaccaaagaagaactagcatggattctcctaaatttcaaccagaaaagaggttactatcaactcagaggagaagaagaacaagaagaaaataataaatcagttgaatatcacgcattaaaagtagtaagcgtggaagacagtggcgaacgaaaaggaaaagatatctggtataatgtaacactagaaaatggatgggtatataggagagcttcaaacattccacttgattggacaggaaaagtaaaagaatttgttgtcacaaccgaattagacgatgccggaaacccaaagaaagacaaagaaggaaatgtaaaaagaagtttcagagctccgaaagaagatgattggggacttctaaaaacacgaacacaagcacaaattgatgaaagcggaaaaaccgtcggcacatatatttacgaaagccttctatgtatgcccaatcagaaaatcagaggaaaattagtcagaactattgaacgcaaatactacaaagacgaactaagacaaatcctagtaaaacaatcagaatttcatgctgcgcttcaagatcataacttacttttaagctgtattgaagaactctacccaaacaacgaagctcacagacgactcctttccgctagttcattcatatatttcttaatagaggatattctattttaccaaagaccacttaaaagtcaaaaaggccttattgataactgtccatacgaatcccacatatacaaagataagaaagacgggagcctccaccatgtaccactaaaatgcgtgtcaaaatcacacccgttattccaagagtttagattatggcaattcttatcaaatttaagaatctaccaaagagaacgaatgatggatggctcgttaaaattggatgtagacgtcactagagaatttctcccatccgaagaagactatgtaaaattgttcgactggttaaacgagagaaaagaaataagtcaaaaattcctattagcatacaaacccttcggtcttaagaaaaacgaacaagcaaactatagatggaattatgtagaagacaaatcgtacccttgcaacgaaactagagcagaaataaaatctagactcagtaaagctggagtacccgaagagttcctaacggaagaaaaagaagaagcgttatggcatattctctatagtatctcagataagaaagaactaacaaaagccttgggaaccttcgctgcgaaaaattgtctaaatgaatcattcgtagaagtcttcgccaaaataccaccatttgaatcgaactacgcagcttatagcttaaaagcaataagaaaattactcgcattaatgaggatgggtaaatattggaacgaacaagcaattgaccgtcaaactagagaccgtattgagaaaatactcacaggcgaatacgatgaaactataagatccagagtcagagaaaaagccatgctcctgacagacataagctcattcagaggactccctttatggttagcatgctacatagtatatgatagacactcggaatcaaaagaacttgtaaaatgggaaacaccagcagatatcgaccactttctaagtaaattcaaacaaaattcgctaaggaaccccatcgtagaacaagtaattacagaatcattacgtacggtccgagacatttggaaacaagaaggaaaaattgatgaaatacatgttgaactcggacgagaaatgaaaaacccagcaaaagaaagagcacgaattacagctcaagtacaagaaaacgaaaatacaaacctacgaataaaggctttgctcgctgaatttatgaatcctgagttcgaaatcgaaaacgttcatccctatagccccggtcaacaggaaattctacgtatttacgaagatggagttctatcgggaatagcagaaaaagacctaccagacgacattactgcaatacttaagaaatttagagagaatgatgttaagaaaagaccaactacatcggaagtattacgctacaaattatggttagaacagagatacagaagcccatacacaggtagagtcataccattaggaaaactctttacacccgcatatgaaatagaacatgtcataccccaatcaagatattttgatgattctatatcaaataaggtaatatgtgaaagtgccgttaacaaactcaaagacaactgcctaggatatgagttcattaagaaacattcaggtgagatggttgaactgggaaacggtgaaaccgttccagttttctcagttgaagaatacgaaagatttgttaaagagtcatatttcggtaatagcaagaaaatgaagaaacttctcctagaggacatacccgacagcttcatcgaaagacaactcaatgatagcagatacatctctcgagtcgttacttcattacttagtaacctagtctgtgaagagggagaacaagacggtctgagtaaaaatgtaatagtgtgtacgggaggtattactgatcggctcaagaaagattggggtgtacaagaagtatggaatcgaataatattacctagattcctcagactgaacgagataacaggcaggacagatttcacgtcaacaagtgttaacggtcacttactccctgcactcccattatatctccaaaagggattcaacaaaaagagaatagatcaccgacatcacgctatggacgctatagtaatagcttgcgccaacagaaatatagtaaactatctcaacaattcttcggctcggaaaaattctgaaatttcccgttacgatttacaaagattactatgtgaaaaggtgaaaacagatgccaatggaaattataaatggatccttcgaaaaccttgggaaacatttacgcaagatgtctacgctgctctaactaacatagtggtaagttttaaacaaaacctaagagtgataaacagaactacgaattattatcaacattacaacgaagcgggtgagaaaagaatgataccacaaactaaaggcgatagatgggccatcagaaaaccaatgcataaggatacagtatatggtgaagtaaacttaagaaaagagaaaactctacccctacgtgacgtagtcaaaaatcccagcattgtagtagacaaaagcctcaaaaataaattatatgaacttctgaaaagtcaatacgatcttaaagcgatagcaaagtactttgaaacccatcaagatgtatgggccgacgtaaatctcaagaaaattaaagtttactatttcacaaaagaaaccaacgaaaggttctttgcaacgcgcaaaagtttagatccaagttttgatcagaagaaaatcgaagaagaagtcacagatacaggcgttcagaaaatcttactacatcaccttcaacaaaataacaatgaccctgatatggcatttagtcctgacggaatagataggatgaatcagaatatgacaatattaaatgacggaaaatggcaccaacctatctacaaagtaaggacttacgaaaaagccgacaaatttgcggtcggggaaagtggaaataaagcaaagaaatttgtagaagccgcgaaaggaactaacttgttctttgctgtttatgaaagcgtccaagaagatgaagcaattggtaaacaagtttgcaaaagaacattcgctactatccccctaaatgaagtaataaaacgtaagaaacaaggactccctgccgcccccgaagatttaaatggtaacttaccaaaatttgttctatcacccaatgatcttgtatatctaccaacggaggaagaaagaaatagctcacgaataatccagccattagacagagaaagaatttataaaatggtaagttcatcaggatctcagtgcttctttatcaaagtattcgttgcaaattcaatctgggacaaaaacgaatatagttccttaaacaaaatggaacgtgcgataacaaacgaaatgatcaaagaaatctgcgtacctatcaaaatagacaggttgggaaatgttagcttaatacaaatttga

SEQ ID NO: 9229 - RNA, 4533 nt, synthetic construct
  misc_feature 1..4533: note = Cas9 variant
  source 1..4533: mol_type = other RNA
atgaaaagaatcctaggactcgatctaggcacaaattcgattggatgggccctagtagactcagaagaacaaagaatattgggaatgggtagcagaataatacccatggatcaaggtgtattggatacattctcgggtggcaaccccgtagaaacccaaacagccgctagaacagtttatagagggaccagaagacttcgagaaagggctctactaagaagagaacgattaatacgagtgctaaacatgatgaaattcctaccagaacactatgcttcccaaatagacttcgaaaaacgattgggtcaattctttgacgaaaaagaaccgaaattagcatggaaacaaaacgacgaaggaaggtttgagttcatattccaacaatcgttcaacgaaatgattgaagagttcaaaaataaaggggtagtaagggaagataagaaaataccctatgattggacaatatactacctaagaaagaaagcattgtctcaagaaatagaaaaagaagaactagcatggatccttttgaatttcaaccagaaaagaggatactaccaacttagaggtgaagaagaagaagaaaatccaaataaattagtagaatactattcactaaaaatagtagacgttattgcagacgaaaaacccaactcaaaaagcgacatatggtattcactacacctagaaaacggatggatttatagaagatcaagtaaaattccgctatttggttggaaagacaaaacacgagattttatagtaacaacagatttaaatgacgatggaacggtcaagaaagacaaagaaggcattgaaaaacggagtttcagggcacccagcgaaaacgactgggtattgctcaagaagaaaacagaatcggacatagaaaaatcacataaaacagtaggcgcatacgtgtatgaaaccttactacaaaatccgatgcaaaaagtaagaggaaaactcgttaggaccatcgaacgcaaattctataaagatgaactaaaacaaatactggaaaaacaacgagaatttcatccagaactacgagacgaagacctatataatgactgcgtaagagaactatataggtcaaatgaaacataccaatttatactttctaaaagagacttcgtgcacctttttctcgacgacattttattttaccaaagaccactacggagtcaaaaatccgctataggggattgcattcttgagttcaagacctacaaagataaagacggaaataatattaaagaatatttaaaagtaatcagtaaatcaaatcccctataccaagaatttcgcatctggcaatggctctataacctaaaaatatacagaaaagaagacgacgaagacgttacgcttcaattcatagcaaacatagaagacaaagaacaactctttgactttttaagcaacagaaaaagtatagaacaaaaaccactactagaatatcttataaaagccaaaggtttaaagaaacaggttaaaacggaagcataccgttggaattacgtcgaagacaaaatatacccctgcagcgaaacaaaaacgatgataagtactcgactcgcaaaagttgaaaacatcccagataacttcttcacaaaagagatcgaacaaaaactatggcacataatatacagtgtaaccgacaaaaatgagttcgaaaaagcactacgaacattcgccaagaaatacgacctagatatagcatctttcgtagataatttcaagaaaataccacccttcaaaaacgaatatggtagctttagcgaaaaagcaataaagaaactgctaccactaatgcgattgggaaaatactggaaatggaacgacatcgacaataacactcaaaacagaatatcgaaaataattacaggagaatacgacgaagaaatcaaagacatagtcagagagaaatcaatcgctctaacaaacgaaaatgactttcaaggattgcaactttggttagcacaatatcttgtatatgggagacattcagaggcagatatcgcaggaaaatggcattccgtagccgacctagaaaagtatctaaatgaatttaaacaacatagtctccgaaaccccatagttgaacaaataataacagaaacattaagagtcgtccgggacatctggcgtaaatatgggcaaggagctgaaaacttcttctcagaaatccatgtagaactgggcagagacatgaaaaatacagcagacgaaaggaagaaaatagtaaacgtcgtaaccgagaatgaaaatacaaatttaagaataaaagcactgctaatggaactgaaaaataactcagatggaaaactcgaagtagaaaatgtaaggccatattcgcccacgcaacaagacatactcaaaatatacgaagaatatgcaataagtacaggactagataatgaaaaagacgaaaaagtaaaagaggacatcaagaaaatatcccgcgtggcacaaccaacaacaacagaacttcaaagatacaaactttggctagaacagaaatattgcagcccatacacgggtaaagttataccattaggtaaactgtttaccgaagaatatcaaatagaacacataatccctaaaagtcgatactacgatgatagcttttccaacaaggtaatttgcgaagcagcagtgaataaactcaaagacaaatgcctaggacttgagtttatcaaaaactaccacggacaaatagtagagaccggcttcgggcaaaaggtcacgatatttgacgaagaggcttatcaaaactttgtaaaacaacattatgcatataaccactccaaaaggacaaaattactattagaggaaataccggagaaaatgatagaacgacaaatgaatgacacaagatacatatcaaaatttgtactaccactacttagcaatcttgtacgagcaaaagagaacgacaacggtgtaaacagcaaaaacgtactaccagtcaatggaaaaatcacaacaatgttgaagcaagattggggactaaacgatgtgtggaatgacttaatacttcctagattcgtaagaatgaacgaacttgctaaaacaatagcattcacaagctggaacgaacaacatcaaaaatatctaccaacagtaccgctagaactgtcaaaagggttccagaagaaaagaatagatcacagacaccatgcaatggatgcattagtaatcgcctgcgctacaagagaccacgttaacctgctaaacaacaaacacgcaaacactgacacgataagatacgacctccaaagaaaattacgtctttttgaaagagtgacatacatagatccacagaccaaaaacaatgtaaccaaagacatacccaaagaatttaaaaagccatgggataattttacagtagatgcaagaaatgaacttgagaaaatcatagtgtccttcaaacagaatttacgaatcataaataaagcaacaaacatttatacaaaatacgaaaatggcaagaaaataaaagtcggacaaaaaggcttaaattgggctatccgtaaacctctacataaggaaactgtctttgcgaaagtgtcattaagaaaaaggaaaaccgttcgacttagcgaggctttaaaagactggaagaaaattgtagacaagaaattaaaacaagaaataaaaagactgacgtgtcaatatggcaagtttgatgtggacacaatacttcgctacttcaaagatagaaaatatcaattcggggaagtcgacgtttccaaagtaaagatgtattattttgacgaagagaatgcagcagtaagaaagaacgtagacacgagtttcaccgaaaaattcatacaaggatcagttacagacacaggaatacagaaaatattattaaatcacctagaagcaaaaggaaataaagtagaaatagcattcagcccagaagggatagaggaaatgaacaaaaatataatacaactcaatgaaggaaaacttcacctccccatttttaaagtaagagtttatgagacaattggcaataaattcagtgtaggagtgaaaggaaataagaaagacaaatatgtcgaagctgccaaaggtactaatttattctttgcaatatacgtagacgaaaacggaattagatcatacgaaaccataccactaaacatagttatagaaagattgaaacagggactctctgtagtaccagagaaaaaccggaaggagcatagtttattattttatttaagccctaatgatcttgtctatgtacctatagaagatgaacgagagaacatacatgcagtgaaccttgatcaacttaataacgaacaacgaaaacgaatctataaaatggtaagttgcacaggaagcgaatgtcacttcgtaccgtactacgtcgcctctccaattgtaaacaaagtagaatacagcagcttaaacaaaataggaaggtcattaactggagaaatgataaaagacgtatgtatcaaactaaaagtagatcgactcggcaacataaaaggaatatcagggctctga

SEQ ID NO: 9230 - RNA, 4533 nt, synthetic construct
  misc_feature 1..4533: note = Cas9 variant
  source 1..4533: mol_type = other RNA
atgaaacggattttgggtctagaccttggcacaaactcaataggatgggcattagtagacagcgaagaacaaagaatattaggcatgggatctcgaataattccaatggaccaaggagttctagacacattttcgggaggaaatcctgtagaaacacaaacagcagccagaaccgcatacagaggcacacgaagattaagagaacgtgccctgttaagacgagaaagattgataagagtgctaaatatgatgaaatttctaccagaacactatgctagccaaatagactttgaaaaacgactaggccaattctttgatgaaaaagaacctaaacttgcatggaaacaaaacgacgaaggtcgattcgaatttatctttcaacagagttttaacgaaatgatcgaagagttcaaaaacaaaggagtagttagggaagataagaaaataccatacgactggacaatatactacctaaggaagaaagccctgtcgcaagaaatagaaaaagaagaattagcatggatcctgctgaattttaatcagaaaagaggatactatcagttacgaggagaagaagaagaagaaaacccgaataagctagtagaatactactcattaaaaattgtagatgtaatagcggacgaaaaaccaaactcgaaaggagacatctggtattctttacacctagaaaacggatggatctatcgaaggagttccaaaataccactgtttggctggaaagataaaactcgagacttcatagtaacaacggatctaaacgacgatggtaccgtaaagaaagataaagaaggtatagagaaaagatcctttagagctccttcagaaaatgactgggtacttctcaaaaagaaaactgaatcagatatagaaaaatcccacaaaacggtaggagcatacgtatacgaaacattgctacaaaacccaatgcaaaaagtaagaggcaaacttgtaagaacgatagaacgcaaattctataaagatgaactaaaacaaatattagaaaaacagcgcgagttccacccagaattaagggacgaagatttatacaacgactgtgtaagggaattatatagaagtaacgaaacataccaattcatattatcaaaaagagactttgtacacctattcctcgacgatatcttattctaccaaagaccactacgttctcaaaagtctgccataggcgactgtatcctggaatttaaaacatacaaggacaaagacggaaataacataaaagaatatctcaaagtaatttccaaaagcaacccactctaccaagaatttcgaatttggcaatggctatacaaccttaagatatatagaaaagaagatgatgaagacgtaacattacaattcatagcaaacatagaagacaaagaacaattattcgacttcttatcaaatagaaagtcgatagaacaaaagccactgctagaatatcttattaaagcaaaagggctcaagaaacaagtgaaaacagaagcatacagatggaactacgttgaagataaaatctatccatgttcagaaacaaaaacaatgatctctaccagacttgcaaaagttgaaaatataccagataatttcttcacaaaagaaatagaacagaaactttggcacataatctacagtgttactgacaaaaacgagttcgaaaaggctttaagaacattcgcgaagaaatacgaccttgacatagcctctttcgttgataattttaagaaaatacccccatttaaaaatgaatacggaagtttcagcgagaaagcaataaagaaattactacccctaatgcgattaggaaaatactggaaatggaacgatattgacaataacactcaaaaccgaatcagcaaaataattacaggggaatacgatgaagaaatcaaagacattgtacgcgaaaaatctatcgccctcacaaatgaaaacgatttccaaggactacaactctggttggcccagtatttagtatatgggagacactctgaagctgacatagcaggtaaatggcattcagtggccgacctagaaaaataccttaacgagttcaaacaacacagtctaagaaatccaatcgtcgaacaaataatcacagaaacactacgagtcgtaagagatatatggagaaaatatgggcaaggtgcagagaatttcttcagtgagatacatgtggagttgggacgagacatgaaaaacacagcagacgaaagaaagaaaatagtcaacgtagttacagagaatgaaaacacaaacctacgtataaaagcacttctaatggaactcaaaaataattcagatggaaaactcgaggtagaaaacgtaagaccatatagcccaactcaacaagatatactaaaaatatatgaagaatatgcaatatcaaccggacttgataacgaaaaagatgaaaaagtaaaagaggacattaaaaagatatccagagttgcacaacccacaaccaccgaactacaaagatacaaattgtggttggaacaaaaatactgcagtccgtatacaggaaaagtcatcccactaggaaaactatttacagaagaataccaaattgagcacatcatacccaaaagcagatattatgatgatagtttctccaataaggtcatatgtgaagcagccgtaaacaaattaaaagataagtgccttggcctcgagttcatcaaaaactaccacggccagattgtagaaacagggttcggccaaaaagtcacaatattcgatgaggaggcttaccaaaactttgtaaaacaacattatgcatacaaccgttcaaaaaggactaaactactgctggaagaaataccagagaaaatgattgagagacaaatgaatgacacaagatacatcagtaagtttgtactaccactactgagtaatcttgtacgagcagaagaaaatgacaacggtgtaaacagcaaaaacgtcttaccagtcaacggaaaaataacaacaatgctaaaacaggactggggacttaacgatgtttggaatgatctgatactacccaggtttgttagaatgaacgaattagcgaaaacaatagcttttacaagctggaatgaacagcaccaaaaatacttacctaccgttccgttagagctatcaaaaggatttcaaaagaaacgtatagaccacagacatcacgcaatggatgcactcgtaatagcatgcgcaactcgcgatcacgtaaacctacttaataataaacatgcgaatacagatacaatacgctacgaccttcaaagaaaacttagattattcgaaagagtgacatacatagatccccagaccaaaaataacgtgacaaaagatataccgaaagagttcaagaaaccttgggataattttacagtagacgcgagaaatgagcttgaaaagattattgtatccttcaagcagaatcttagaataataaataaggcaacaaatatatatacgaaatacgaaaatggtaagaaaattaaagtaggccagaaaggtttaaactgggccatacgaaaaccactacacaaagaaacagtctttgcaaaagtcagcctgagaaaacgaaaaacagtacgcctttccgaagcactaaaagactggaagaaaatagtagacaagaaacttaaacaagagataaaaagattaacatgtcaatacggtaaattcgatgtagacaccatattgcgatactttaaggaccgaaaataccaattcggcgaagtagacgtttctaaagtaaaaatgtactattttgatgaagaaaatgccgcagtcaggaaaaacgtagacacatcatttacagaaaagttcatacagggatccgtaacagataccggaatacagaaaattttactcaatcatttagaagctaaaggcaataaagtcgaaatcgcctttagcccagaaggcatcgaagaaatgaacaaaaacataatccagctaaatgaaggaaagttacatctgccgatatttaaagtccgagtatatgaaacgatcggaaacaagtttagtgtcggtgtaaaaggtaacaagaaagacaaatacgtagaagcagcgaaaggaaccaacttgttcttcgcaatatatgttgatgaaaatggaataagaagctatgaaaccatcccactcaatatagttatagagagactaaaacaaggtctttcagtagttccagagaagaacagaaaagaacactcattactattctacctaagccctaatgacttagtatacgtcccaattgaagatgaaagagaaaatattcacgcagtcaacctagatcaattaaataacgaacaacgtaaaaggatttacaaaatggtctcctgtacaggatctgaatgccattttgtaccgtattacgtcgcttcacccatagttaataaagtggaatacagttccctaaataaaataggacgaagtctaaccggggaaatgatcaaagacgtttgcatcaaactaaaagtagacagattaggtaatgtaaaaggtatttctggtctatga

SEQ ID NO: 9231 - RNA, 4536 nt, synthetic construct
  misc_feature 1..4536: note = Cas9 variant
  source 1..4536: mol_type = other RNA
atgaaaaaaatcctgggtttagatcttggaacgaactctataggctgggccgtgataaactcagttgcggacgagagcgtagaaaaacgaaacatagaactagcaggttcccggataatcccaatggacgcagcagtactaggcaatttcgacaatggtgtcacaaaatcccaaaccgccgaaagaacatcttaccggagtataaggagattaagagaacgacaattactaaggagagaaagattacataaagtactacaaatactaggttttctcccagaacattacgtaaacgatatagattttgaaaaccaccctggaaaaataaaaaaaaacaccgaacctaaattaccctggagaaaaaatagtatgggacaattcgaattcattttccaagcttccttcgaagcaatgctaacagactttgcaactcatcagccagtttttgtaagtgaaggtaaaaaggtacattacgattggacactatattatttacgcaaaaaagcattaacggaagaaattagtaaagaagaacttgcctggatcatactcaattttaatcagaaaagaggatattatcaattgcgaggagaagaggaagaagagcagagtaataaactagtagaattctatgctctacgagtagttaaagttgaagctacagatgataaaaaaggaaaagacacatggtacaatgtccatttagaaaatggatggatatatcgccgaacttcaaacattccccttgactgggagggtaaagtaaaagaattcatagttacaacagatctcaatgaagacggaactccaaaacttgataaatacggagaagtaaaaagatcattcagagcgccaaaggaagatgactggacattaataaagaaaaagaccgagagcgacatagccaatagtcacaaaaccctaggctgttatatttatgacgcactccttcaaaaccccaatcaaaaaataaaaggaagattagttcgaacagtagaacgaaagttttacaaagaagaactcagattgatcttagaaaaacaattaagtttccatcccgaactacaagatcgagacctatacagggcgtgtatagatgctttatacgtatcaaacgaagcccataaaaacaatattagtggaagagatttcgtgtacttatttatagatgacataatattttaccaaagacctttgaaaaccaaaaaatcattaatagacaactgcccctatgagaaaaaccaatacatggatagagaaacaggtgaagttaagcaagcaccaataaaatgcattgcaaaaagccaccccttatttcaagaattcagactatggcaatttataagcaacataagaatataccagagggaacgcgtgatggacgatgggaaacttgaaacagatgtagacgtaacacctgactttttaaagacagaagatgactacaccacactattcgagtggctaaatgatagaaaagaagtggatcaaaaagcctttctaaaaaatccacaattcggactgaagaaaactttcacagagtatcgatggaattatgtggaagacaaatcatacccatgcaacgaaacgcggaatgctatactgaatgggttacaaaaggctggtgtcagtgcggacttcttatcacgcgaggtcgaagaagcactatggcacatcctatacagcgtagaagataaaatcgaaatcgaatcagcactacgtaaatttgcaagtaaacacgacctagacgataggtttgcggatgtattcaaaaaactcccccccttcagaaaggaatacggagcctatagtgccaaagcaataaaaaaacttttacctttaatgagaatgggaaaatactgggaactaagcaacatcgacgacaaaacaaaagaaagaatagataaaataataaccggtgaatgggatgaaaatatacacaaccgagtacgagaaaaagcaattaaactatcagatataacagacttcaagggattaccattatggttatcgtgctatgtggtctacaatcgacacagcgaagcacgggccatagctaaatgggaatcccccgaagacatagactcatacctacgattgttcagacaacatagtctccggaaccctgtcgtcgaacaagtaattacagaaactctacgcaccgtaagagacatctggaaacgaataggccaaatcgacgaaatacatgtcgaattaggaagagagataaaaaatccagcagacaaaagagctaaaatgacagctcaaatcgtagaaaacgaaaacacaaacctaagaattaaagcactactagcggaatttataaactcagaatatgaaatagaaaacgtaagaccatatagcccgggacagcaagaaatcctaagaatatatgaagacacagttttaaacagcgtcgaagaaataccagaagatataagcgcagtcttaaaaaaattccgtgaatccgatctaaagaaaagacctacaaaaagtgagtttcttcgctacaaactatggttagaacaaaaatacagatcaccatatactggtgacatcatcccattgggtaaattatttacaagcgcatacgagatagaacacataatcccacaatcaaggtactttgacgactccttctcaaataaagtaatatgtgaagcagaggtaaataaattgaaatcaaatgaacttggatacgagttcataaaaaatcatcacggacaatacgtagaaataggattcggaaaagtagtgcaaatattttcaatagaagcttacgaaaaatttgtaaaagcgaactactccggaattggaagtaaaatgaaaagattactaatggatgatatacctgaaaccttcattgaaagacaattaaacgattcgagatacatatcaaaagtagtaaaaagtctcttaagcaatatagttcgagaaaaagattcaaatggtgaatatgaaccagaagcaataagcaaaaatgtaatagtatgtacaggaagtgtcacagaccgcctaaaaagagactggggagtaaatgacgtatggaactcgatcatataccctaggtttgaacgcttaaatgaactaactggttcccagcagtttggatgttgggaaaataaagaaggcaaaagagtcttccaaacagcagtaccattggaaatgcaaaaggggttttcaaaaaaaagaatagaccacagacaccatgcaatggacgcgatagttattgcatgcgctattcgaaatcacataaattatttaagcaacgaatccgcttctaagaaagcgaaaatatccagaatagacttacagagattattatgtacaaaatgccgaacagatgacaatggaaattacaaatggatagttaaaaaaccgtggcccgcctttactcaagatataagaaaagctctcgagaacatcacggtatcctttaaacaaaacttaagagtaattaacaaaactactaattactacgtacattttgacgaaagcggaaaaaaagtactagaaaaacaaatcaatggagatagctgggcaatacgcaaaccaatgcataaagacacagtatttggaaaagtaaacttacaaaaagtgaaagaagttagattatccttagcattagatacacccaagatgatcgtagacaaaaagctaaaagaaaaagtgttacaattatacagctataagtacgacaaaaaaagaatcgacaaatattttaaagagaacgcaagcctttggaaagacctcaatttaagcaaagtagcagtgtactacttcacaaacgacagcaccgaaccactagtagcagtaagaaagcctctagacacatcgttcaatgccaagaagataaaggaatctgttacagacaccggaattcaaaaaatacttttgaatcatctaagcaacaaccaagataatcccaacctagcatttagcccagacggaattgacgaaatgaatcgaaatttaactacactcaatgatggaaaataccaccagccgatatataaagtcagagtttgcgaaccacaaggtaataaattctccgtgggtactagtggcaataagaccagtaaatatgttgaagcagctaaaggcacaaacttgttttttgcagtctatcaaacagaagacgggaaacgaaattacgaaactatacccttgaacgtggtaatagaacgggagaaattggaatgggcccctgtgcctgaaaataacaataatggtgacaaactactattctggctaagccctaacgatctcgtatacgtgccgacggcagatgaattgaacaacggaatgagactggataacatggataagggacgtatctacaaaatgatatcctgctcaggtcctcaatgtttttttattccacaaaatgtgtcaaatcccatcattccagttatagaactgggggtaaataacaaagcagaaaaaagctggaataacgaaatgataaaggtagtatgcgtacccatacgagtagatcgcttaggctgtataacacaaataaataaccaaaaatga

SEQ ID NO: 9232 - RNA, 4539 nt, synthetic construct
  misc_feature 1..4539: note = Cas9 variant
  source 1..4539: mol_type = other RNA
atgaaaaagatattaggccttgatctaggaacaaatagtattggatgggctttaatcgaaaactcctttactgaaaaagaaggaaaaataaatgacatgggcgttagaataatacccatgtctgccgatatcttaggcaaatttgacgcgggccaaagtcattcgcaaaccgccgaacgaacaggataccgtggaacgaggaggttatatcaacgagacaatctcagacgagaaagactacaccgagttctacatatactaggcttcctaccgaaacattatgatgaacatatagattttgagaaaagactaggacaattcaaagaaggcaaagaaattaaattgaattacaggtgtaatgttgaaaacaaacacgagttcatttttataagctcattcaacgaaatgctaacagaatttaagaaagcccagccggaactcttctaccttaaatccaacggagaagaaacaaaaataccatacgattggacactctactatctacgaaagaaagcgttatcacaaccacttaccaaacaagaactagcatggataatactgaacttcaaccaaaaacgaggatattaccaattacggggagaagaaatcgatgatgacaaaaataaacaatttgttaaactaaaagttaaagaagtaatcaacagcggagaagccgtaaaaggaaaaccattatttgacgtaattttcgaaaacggttggaaatatgataaacaagtggtgaaaacagaagattggatagacagaactaaagaatttatagtcacaacaaaggtcttgaaaaatggagacctaaaaaggtcatataaaacggtagactcggagaaagactgggcagcaattaaagcaaaaacagaacaagatatagaaagaagcaacaaaacagttggagagttcatctatgaaactctattagaaaacccaacccagaaaataagaggaaagctagtaaaaacaatagaaagaaaattttacaaagaggaactgaaaaatatactaataaaacaaatagaattacaacccacactattcagcgaagaactatataaagcctgtattgaagaattgtacccaagaaatgaagcacatcaaaacgccatcaaaaatcgcgatttcatatatttattaatggacgacatcattttctatcaacgaccgttaaaatcgcagaaaagcaacatcagcggctgtcaactggaacaaagggtatattacaaagcaaataaagacagcggagaaaatgaagaagtcaaacaagccgtcaaagccatcccaaaatcgcacccgttatttcaagaatttcgtaattggcaatggttacagaacctaaaaatctacaacaaagttgacaccgagaaaggagaactcactgacgtaacaaaacaattactaccaagtgaagacagttgggtaaatctatttaattttcttcaatgcaagaaagaactagaacagaaacaattcataaaatactttatcgataagaaattaataaacaaaacagaaaaagaccattaccgatggaattatgtcgaagataagaaatatccttttacagaaacccgagcgcagttcatctcacgcctcactaaagtcgaaggaatagaagaaataaataccttcctagataagaaaacacaaataggtacaaaagataattccccattcgtttccagaatcgagcagctatggcacatcatctattcagtaagcgacattaaagaatacgaatctgccttagaaaaattcgctataaaacatcacttaaacgaagaatcttttgtagcaaacttcataaagttcccaccatttaaatcagattacggatcatactctaagaaagctctaaataaactgcttcctctaatgagaagaggcaactattggacagaaaatgacatctccgaaaaagtaaaactacgcgtttcagaaataatggagagagtaaacgccctaaacttaaaagaagactatagcagcaaagaacttgcagaaacactcgtgaatgtatcagacgacgacgtaaagaaacaactaataaaatcattcgtatcttttaaagatcgcaatccgctcatgggattaaataccttccaagcaacttacctcgtttacggaagacattcagaagtaggagatatacaaaactggaaaacgccagacgatattgacacatatttaaagaattttaaacaacactccctccggaatcccatcgtcgaacaagtagtgacagagacattaagagtagttcgggacatatggaagcatcatggcaaatctcaaacaaacttctttaatgaaatacatgtcgagttaggacgtgaaatgaaaaatcctgcagacaaaagaaaacgcatatctgaacgaaacaccgaaaatgaaaacactaacaatcgaataagagaaatccttaaagatctaatgaacgacgctagtattcaaggagacgtacgagactattcgcccagccagcaaggtatactcaaaatctatgaagagggagtatatcaaaacccaaaagtggattactcgaaagtgtccgaagacgaaataacaaaaattcgaagatcaaacaaccctacccaaaaagaaatacaacgatacagactctggctcgaacaaggatacataagtccctatacttgcaaacccataccgctctcgaaacttttcacccaccattatcaaatcgaacatatcatacctcaaagtagatacttcgacaactccagtagtaataaaatcatatgtgaaagcgaggtcaacgaagacaaagacaacaaaacagcattcgaatacctcaaagacaaaggagaaaacgtcataaacggccacaaattattatctttagcggcatatgaagcacacgtaaacaaatacttcaaaaacaatagacaaaaactcaaaaatctattaagcgaagatatacccgagggatttataaacagacaaatgaatgactcaagatatatatccaagctagtaaaaggactcctttcaaacatagtaagggaagaaggcgaacaagaagtcacaagcaaaaatctaattccggtcactggctcagtaacatcaaagttgaaaaacgactggggtttaaacgataaatggaatgaactaatactaccacgctttaaaagactaaatcaactcacacaaaccaacgactttaccacagccaacacaaacggaaataccataccaaccgtaccggacgagctactcaagggtttcagcaagaaaagaatcgatcatagacaccacgctctagatgcattggtggtagcatgttgcacaagaaaccatagcaactacttatcagcactaaacacagaaaacaaaaactacggcttaagagataaactattaatcaaaaacgacaatgatcattatactaaatcatttcaaatgccatggcatggatttacaacagaagcgaaaaaccaactagaagaaacggtaatatcatttaaacaaaacctaagagtaataaataaagcaaacaataaattctggagctataaggatgaaaacggaaagttaaacctagataaaaatggaaaacctatcaaaaagttaagaaagcaaactaaaggagacaattgggcagtaagacaaccattacacgaagaaacaatatcaggaattgtaaatctaccatgggttaaagcagaaaaggagaaattcacatatgcaacacggaagtcactcgataagagtttcgatctcaagaaaattgagaaaattacagacactggaatccagaaaatcctacgaaattacttaatgcaagaaaaatttaaagaattagataagaaagacaaagaagtatataattcggaattagcgttcagtcaagagggtctcgaagacttaaactcaaatatagagcagttcaatgaccaaaaaccacacaaacccatatataaagtacgcctattcgaaaaaggatcaggtcgatttgcactcggtttcaaaggaattaatgcaaagaaatacgcccaaggctcacctaatctgtattttaatatctaccgaaatgaagatggacaatactacgagactgtaccactcaacaaagtaatcatacatcagaaaaacgctgcaaacatgcctaaaaagaatagaactccagttccgatttcaaacacagcgataaacagaagcaaagaagtactcgtagactacaagatgaccttatcgcccctagaccttgtctacattccgactgaagaagaactaaacaatataaattcactagactttaacaacttatcgaaatctcaaagaaaacgattatacaatgtaaatgactttagcggatacaccatatatttttcaccaaatacacttgcaaaatctatatgtcccaaagaggtagatatgaaattcgacgagaagaaacagaaaccaacaggaagtttcgacagtaaaacagccagcctagacggaatgtcaatcaaagaaagatgcataaaacttattatagatcgcctcggcaacatatcaaaagcatga

SEQ ID NO: 9233 - RNA, 4539 nt, synthetic construct
  misc_feature 1..4539: note = Cas9 variant
  source 1..4539: mol_type = other RNA
atgaagaaaatactcggactggatctaggaactaatagtataggatgggcagtagttaatgcagacgaaattacaagagacgacggaagccgatatttaaaaccaaacggaataagcgcggcaggatcgagaataataccaatgagtgcagacatcttaggagatttcgaaaaaggaaacagcataagccaaacagcagaaagaacacggatgagaatggcaagacgtctacatgaaagagcacttttaagaagagaaagactattacgagtactaaacctactagatttcctacctaaacattttgcagacaaaatcgacagatatggcaaattcacagacgattcagaaccaaaacttgcatggaggaaaaatacagaaggcaaatatgaatttatcttccaagacgcatttaatgaaatgcttgctgaatttaaagataaacaaccagaaattgtggaagaaggtaagaaaataccatacgattggaccatttattatctcagaaagaaagcattagaaaaagcactctcaaaagaagaactaagctggatactactacaattcaatcagaaaagaggctattatcaattaagaggcgaagaagaagaaatcccacaagacaagaaaattgaatacctagcacaaaaagtagtgaaagtagaagcaactgatcaaaagaaaggagacgatgtttggtacaatgtatatctagaaaacggaatgatatatcgcagaacttcaaaagccccgctggattgggaaggaaaagtcaaagaatttatagtaacaacagaagtggaaaacgacggcgaaacacccaagaaagataaagaaggaaacataaaaaggagcttcagagctcccaaagaagatgattggaccttgctcaaaaagaaaacagaagcagacatagaaaactcacataaaacagtgggctgctatatatacgactcattactaaataatcctaaacagaaaataataggaaagttagtaagaacagtagaaagaaaattttataaagaagaactaacacaaattctcaagaaacaagttgaattaataccggaactcagagacgacaacctttacaaacaatgcatagaggaactctaccctataaatgaagcacatcgaaatacaattgctaaaacagactttgcaaatttatttataaacgacatattattctaccaacgcccactaaaatcgaagaaatcacaaatagataactgcccctatgaagaaagaatatttatcgattccaaaacaggggagaaaaagaaagtaccggtaaaatgtattgccaaaagtaatccgctttttcaagaatttagactctggcaatttatacaaaaccttagaatatatcaaagagaaaaagagatagacggcaaacttctaactgatatagatataacatccgaatgccttaaaagtgaagaagactacgtgcgattatttgattggctgaatgaccgggaaactatcgagcaggaagacttgttaaaacatctattcaacacaaagaaaagcaaaaataaagaaaacccctataggtggaactatgtggaagacaaagtctacccttgcaacgaaaccagagcaactatccttaaagggttcagtaaatgtgggataaatgccagcgtgctaagtccggaattagaaatggcattgtggcatatcttatattcagtggaagataagaaagaaatcgaaacagctttaacacactttgcccaaaaacaaggatggaatgatgacttcgcgaaagtattttcaaaagccaaaccattcaagaaagactacggttcctacagtgaaaaagcaatcaagaaattgctttcactaatgaggatgggaaaatactggaaccaggacaatattgacaaaaatacattagaccgtatagataaaataattaacggcgaatatgatgagaaaatttcaaaccgagtaagggacaacgcaataaacctaaaagatatatcagactttcgaggactaccagtatggctagcgtgttacatagtctacgacaggcattcagaagctaaagattgcacgaaatggaatagccctgaagaaattgacagctatctaaagaaatttaaacaacattcattacgcaatccaattgtagaacaagtggtaactgaaacgttacggacagtcagagacatatggattcaagaagaacaaattgatgaaatacatttagagctaggccgtgatctgaaaaacccggctgacaaacgaaagaaaatgtcagaaaacatattgaaaaacgaaaacacaaacctacgtattaaagctatgctaatggagtttatgaatcctagtatgggtattgaaaacgtaagaccatactcaccatcacaacaagacattctaagaatatacgaagaaaatgccttagacaatctaacgaaagacgataaagacttcgatttcatatcaaaaatatccaaacaagcacaaccctctaaaactgacatcataagatacaaatgttggctcgaacaaaaatatagaagtccatacacaggaaaaaccatatcgttatcaaaactattcactcccgcatatgaaatagaacatgttatcccacaatcactatacttcgacgatagcttcagtaacaaagtaatatgtgaagccgaagtcaacaaattaaaagacagacaattaggctataagttcatagcggaacatcacggcgagaaagtacaactgagtcaaggagaagtagtagaaatactaagtgttgacgcatatgaaaaattcgtgaaagaaaactatgcaaataatcgaataaaaatgaagaaattactaatggaaagcatccccgacgagttcatcgaacgacaactaaatgacagcaggtacataagtaaagttgtaaaaggtcttttaagtaacatagtaagagagaaaattgacgacgaaaactacgaacctgaagccgtgagtaaaaacctaatatcatgcaacggcgcgatcacggacagattaaagaaagactggggaatgaatgatgtatggaactctattattctaccgagattcataagaatgaatcaaatcacaggtaaagattgctttacaactactaacgcagaaggccatttaatcccacaaatgccactcgaactgcaaaaaggatttaataagaaaagaattgaccaccgtcaccacgcaatggatgcaatcgtaatcgcctgtaccaccagagaccacgtaaatcttttgaacaacgaagcggcacatagcaaattcaatgcgacaagatatcaattacaaagaaaattaagaaggtttgaaaaagcagtaatagatggtaaagaaagggaagtagccaaagagttcttaaaaccgtgggacagtttcagtagcgacagcaaaaacattctagagaacataatagtatcatttaaacaaaaccaacgagtaatcaataaaactactaacgctttcttacattttgacgagaacggtaagaaaacattcatcaaacagggaaaaggtgacagctgggcaataagaaaatcgatgcacaaagacaccgttttcggcgaaataaatctgcgaaaagtgcgctctgtcagcctcaatgaagcaatcaaggtaccagaaagggtgctgaacaagaaaataaaagagaaaatattagaactcaagaataataaaattgacgccaaaaatatcaagaaatacattgaagaaaaccacactggaggatacggtatagactcttccaaaatcgatgtattttatttcaccaaagaaactaaagaaagattcttcgcgacaaggaaaacacttgatacttcatttaaccaagcaaaaataaaggacagtatcgcagattccgggattcagaaaatactcctcgcccatctaaaatcgaaaaacggagatgcagaacaagcattcagtccagacggaatagatgagatgaacaaaaatatagtagaattaaacaacgggaagttccatcaaccaatacttaaagtaagagtctatgaaaaagcagataaattcgcagtcggacaaaagggaaataagaaagttaaattcgtagaagcagccaaagggacaaacctattctttgcaatattcgagaaagatggcaaaagatcataccttactataccactaaatgtaatgatagattgtcaaaaacaatatggaaatcaatggaaaaataatatagaggcttatctcaaagaaaaggagttagtagaaaaggatgtgaaactccaattcattctaagtcctaacgacctagtatatttaccaacagaaggttcaatagacaagaaacgaatttacaaagtcgttagttttaccaataaccgattatacgcgatcccatacgcaatagctaaatccatagttgataagaacgaatttactcagctgaacaaaatcgagttcacagacaataaagaatcaatcaaagacgcgtgcgtaccagtcataatcgatagactaggtaacgttatagagttcaatggcaaaagactctga

SEQ ID NO: 9234 - RNA, 4539 nt, synthetic construct
  misc_feature 1..4539: note = Cas9 variant
  source 1..4539: mol_type = other RNA
atgaagaacattctaggactcgatcttggcactaattccatcgggtgggcagtaatcaacagcgaggaagatggaccaatcgtaaaaaagagaattgaattagcgggatcgcgcattatcccaatggacgcagcagtactagggaatttcgacagtggagtaactaagtcacaaaccgctgaacgaaccagctttagaagcattagacgcctgcgagaaagacaattattgcgaagagaacggcttcataaagtgctacaaatcttaggattcctccctgagcactacgtaaatgatatcgactttgaaaaccacccaggaaaaataaaaagaaacacagaaccgaaactcccatggagaaaaaatagcatgggacaatttgaattcatcttccaagactcatttgaagcgatgctcactgatttcgctacccaccaacccgtatttgtatctgaaggtaaaaaagtaccatatgattggacactgtattacttacgaaaaaaagctctaacagaaggtatctctaaagaagaactcgcttggctgatattaaacttcaaccaaaagagaggttattaccaactacgtggtgaagaagaagaggaacaatcaaataaactcgtcgaattttatgctttaagagtagtaaaagttgaagctacagacgataaaaaaggaaaagatacgtggtacaacgttcatttagaaaatggatggatttatcgaaggacatcaaatatacctttagactgggaaggaaaggtaaaagagtttatagtaacaacagatctaaatgaagatggcacaccaaagttagacaaatacggcgaggtaaaacgttcctttagagccccaaaagaagatgattggacactcataaaaaaaaaaactgaatcagacatagctaattcccacaaaacagtcggctgctatatttacgacgcgttacttcaaaacccacatcaaaaaataaaaggaagactagtacgaactgtagaaaggaagttttacaaagaagaactacgtttaattttggaaaaacaactaagtttccaccctgaactacaggatcgagacctatacagagcatgcatagacgctctgtacgttagtaatgaagcacataagaataacataagcggtcgagatttcgtatacttatttattgatgatataatattctatcaacgtccactaaaaactaaaaaatccttaatcgataactgtccatatgaagaaaaccagtacatggatcgagaaacaggagaagtcaaacaagcaccaattaaatgcatagcaaaaagccatccactctttcaagagttcagactctggcaatttatatcaaacatcaggatataccaaagagaaagagtgcttgatgatggaaaattagaaacagacgtagacgtcactcctgactttctcaaaacagaagacgattataccaccttattcgaatggtttaatgatcgaaaggaagtcgatcaaaaagcattcctaaaaaatcctcaatttggactcaaaaaaacattcacagaatacagatggaattacgtagaagataaatcatacccctgtaatgaaacaagaaacgctatactaaacggacttcaaaaggcaggagtttctgcagactttctatcaagagaagttgaggaagctctatggcacattctatatagtgttgaagataaaatagaaatcgaatccgcactacggaaatttgcttcaaaacatgacctagacgatcgatttgccgacgtgttcaagaaattaccaccgttcaaaaaagaatacggagcttacagcgcaaaagcaatcaaaaaattactaccattaatgagaataggtaaatattgggaactttcgaatatagacgataaaaccaaagaaagaatagacaaaataataactggagaatgggatgaaaacatacacgacagggtcagagaaaaggccatcaaactatcagacataacagactttaaaggattaccattatggttatcatgttatgtcgtatacaatagacactctgaagcacgagccatagcaaaatgggagtctcccgaagacatcgacagctacttacgcttgtttagacaacactctttacgtaatccaatcgtagaacaagtaatcacggaaactttgcgaacggtaagagatatatggaaacgcgtggggcaaatagatgaaatacatgttgagttaggacgggaaataaaaaacccagccgataaacgtgcaaaaatgactgcgcaaatcgttgaaaatgagaatacaaatttacgcataaaagctttattagccgaattcatcaattccgaatatgaaattgaaaacgtacgtccctatagctcaaaccaacaagaaaaactaaagatatacgaagatactgtcctcaatggtgtaaaagaaatacctgaagatatcaacacgatattaaaaaagttcagggaaagcgatctcaaaaaacgtccaacaaaaagtgatttcctgcattacaaactgtggctcgaacaaaaatactgctcaccctacacaggacgaataatacctttaggaaaactttttacttcagcatacgaaatcgagcatattataccgcaagcacattatttcgatgactcattttcgaacaaagtcatatgcgaagcagaagtaaacgggttaaaagataaaaaactcggatacgagttcatcaagcataacccaggaaaaatggtggaaataggctttggaaaacctcctgtgagaatattctcagtagaggaatacgaaagatttgtcaaagaaaattactcaggaattaaaaataaaatgaataaactattgatggatgacataccagaaacgttcatcgaaagacaattaaacgactcaagatatatatcgaaagttgttaaaagtttactatcaaatatcgtacgcgaaaaagactcaaacggtgaatacgaaccagaagcaatatccaaaaacgtaatcgtttgtaccggatcagtaacagatagactcaaaagagattggggtgtcaatgacgtctggaattcaataatttatccacgcttcgaaagattaaatgaactaacaggctcacaacaattcggatgctgggaaaacaaagaggggaagcgagtgttccaaactgcagtaccccttgaaatgcaaaaaggatttagtaagaaaagaatcgaccatcgacatcatgctatggacgccattgttatagcttgcgcaacacgaaaccacataaattatctatcaaacgaatcggcgtctaaaaaagcaaaaatatcaagaacagatttacaaaggctactatgtacaaaatgcagaacagacgataatggcaactacaaatggatagtcaaaaaaccctggccggcatttacacaagatataagaaaagcactagaaaacatcacagtatctttcaaacagaacttgagagtcatcaataaaacaactaattactatgtacactttgatgaatcaggtaaaaaagttttagaaaaacaaataaacggtgacagctgggcaatacgaaaaccaatgcacaaggacacagtctttggcaaagtcaatctacaaaaagtgaaagaagtaagactcagtctcgcattggacacaccaaaaatgatagtagataaaaaattgaaagagaaagtactacaactctattcttacaagtacgataaaaaaaggattgataaatattttaaagaaaatgcttctctgtggaaagacctgaacctaagtaaagtagcagtatactattttacgaacgactcaactgaaccattggtcgccgtgagaaaaccacttgatacaagcttcaatgcaaaaaagattaaagaaagcgttactgacacaggaatacaaaaaattctgctcaatcatttatctaacaatcaagacgacccaaaccttgcatttagtccagatggaatagataaaatgaacaaaaacttaaccgccctaaatgacggtaaatatcaccaacctatttacaaagtcagagtatgtgagccacagggaaataaattttcagttggaacatcaggaaacaaaaccagcaaatatgtagaggcagcaaaaggtacgaacttattctttgcagtatatcaaacggaagatggtaaaagatcttatgaaacaattccacttaacgtagtaatagaaagggagaagctaggctggaccccagttccggaaaacaacaacaatggcgataaactactattttggttatccccaaatgatttagtatatgtaccaaccgcagacgaattaaacaatggtatgagattagacaacatggacaaaggtagaatctacaaaatgatttcatgtagcggtccccaatgcttctttataccccaaaatgtaagtaatgcgattatacccgtgatagaattaggagctaataataaagctgaaaaatcttggaataatgaaatgatcaaagttgtatgcgtgccaattagagtagataggctcggctgcattacacaaatcaacaaccaaaaatga

SEQ ID NO: 9235 - RNA, 4551 nt, synthetic construct
  misc_feature 1..4551: note = Cas9 variant
  source 1..4551: mol_type = other RNA
atgaaaaacatattagggctcgacctaggaactaactctataggatggagtgtaatccaagaaaaacataatgaaaataatgaatgccaaaaattaatattgggagcaggatctagaataataccaatggacgcagcagtattaggcgatttcgccaaaggcaataccatttcacaaacaaaagaccgaacccaatatagaggagtaagacgtctaagagaaagatgcctactacgcagagaaagactattccgcgtactcgatataatgggattcttaccccaacattttagtaatgctttaacaaggtatggtaaatttaaagatgcagatgaagaaccaaaaatagcatggagaaaagacgatgaagggaaaatgcactttctatttgctgactcctttaacgaaatgattgaagaatttcgctcagtacaacctgaacttctaaaacgcggaatgaaagttccatacgactggaccctctattaccttagaaagaaagcgatgagagaagcagtaactccattcgaattggcgtggttaatactatcatttaatcagaaaaggggctactatcaattaagaggagaagaagaaggagaagccgataattccaaatcagaagaatatctagcacaacgagtagttgatgtaatagatacaggagagaagaaaggtaaaagtacatggttcgatattgtactggaaaatggaatggtgtatcacagaccggcagaaataaaaccagattggataggaaaaacaaaagaatttatagttactacacaatttgataaagacggtaacccgaagaaagacaaagaaggaaacgtaaaaatgagtttcaggatgccaaatgaaaacgattggaatcttcagaaaaagaaagcggaaaaagatatagacgaaagtgggatgaccgtgggagaatatatctacaatgccctattacacaaccccaaacagaaaataaaaggaaaattagtaagagtcgtagaaagaaaatattacaaaaacgaattacagaaaatacttgaatcacagaaaagatttataccacaattaagcgatagtgctttatatgaaaaatgcattaaagaactatatcaatcaaacgaagcatacagaaactcaataagcacaaggaatgacttcacatatttattcgttgataacatcatcttctaccaaaggccactaaaaagcaagaaatcattgatagataactgtccatacgaatctctagcatatacaaaagacggagaagaacacaaagcacctgtaaaatgtatagcaaaatcacacccactttaccaagaatttaggttatggcaattcatctccaacttgcgaatataccaacgtcaaaaacaagtgggagacaaagtaaaactagacgtagatgtcacagatgaatttcttccaacagacgatcgtagagaaagtttgttcgactatttaaacgacaaaactgaaataaaacaagatgtattattaaaagagttcttttcaatgaagaaaccaaaaggtaaagattcagtatacccatacagatggaactacgttgaagacaaatcatatccctgtaacgtaacaagaggcaaaatactcgcaaaactaaacagggccggaatatccgcggactttctatcaagtaatggaaatgaagaaagtctttggcacatactatactcagtggaagataaaggtgaattacgtaaagcactcgcaagatttgctgctaaaaatggactagacgatgccttcacagaagcattggcagatatagaaccatacaagaaagaatatggagcttactcggccaaagcgctaaagaaattactaccgcttatgagacttggaaaatactggaactatgataatatcgctccagccacaaaagcgagaataagcaaaattatagacggcgaatatgacgaaaacatcagaaatagagtcagagaaaaagcaatgtcactcaacagcgcatcacaattccaagggctaccactatggctagcttgctacatagtttatgacagacactctgaaagagcagatagcggcagatggagttcaccagaagatattgataaatacctatcggatttcaaacaacatagccttcgaaatccgattgtagaacaagttgttacagaaactttaagaactgttagggacatctggaaaaggtacggcgaaatatccgaaattcatgtcgaacttggacgcgaaatgaaaaatccagcagacaaacgttcaaaaatgaaccgacgtatgctagaaaatgaaaatgcgaacatgagagccaaattactcctcactgagttcatgaacccagagttcggaatagaaaacgtaagaagctacagcccaagtcaacaagaactcttacgtatttatgaagatggcgcaatatccaatgcaggcagtgaaatagacgatgaaatatcagatatcatgtcaagattgagccaagtagacgttaagaaacaaccaaccgcatcagaagtaaaacgctacatactctggttagaacaaaactacagatcaccctacacaggccaaatgataccacttgctaaacttttcacgccagcatacgaaattgaacatgtaataccccaatcccgttactttgacgattcatttagtaataaagtaatttgcgaagctgaagtaaacaaactgaaagatcgtatgctaggatacgagttcattaaacaacacaaaggagagaaagtttcattaagcatgggagggaccgtcgaaatattatcaccagaagaatacgtaagacacgtcgagagccaatacaaaaacaataaagcaaaaatgagaaaactattaatggacgacatacccgacgaatttatcaacagacaactgaacgacagccgatacatttccaaactaatcataagtctactatcaaatatagttcgagaagaaggtgaagaagaagcaacttccaaaaatgtaatctcatgcaacggatccataaccgacaggctgaagaaagattggggcatcaacgatgtgtggaaccacataattctaccaaggtttcggagacttaacgaactaactggaaccgacaagttcactacatcaaataaagaagggcacgaagtacctgagatgcctctagaactacaaaaaggctttaacaagaaacgaattgaccatagacaccatgccatggatgctatcgtaatagcatgtataacaagagaccacgtaaatctcttaaataacgaagcagcaatgagcaaaaacaatgcaaaccgaatacaattaagtaagaaactgcgacgttatgagtcggtggaaatagaaaaggatggcataagaaagcaaatttcaatggccaaggagttcaaaaagccttgggaaggattcacagcagacgtagaacgaacattacgtgatatcgtggtttctttcaagcaaaacctacgagtaataaacaagaccactaattactatcaacatttcaaagatggcaagaaaatatattcaccccaatctaaaggagattcttgggccatcagaaagtcaatgcataaagaaaccgtattcggcgaaataaacatcaggcgaataaaagaagtgtcacttaaagaagccatgaaaaggataaaggatatagcagacaaagaacttcgatcgaaaatagtagaattaatggcactacaatacaatgagaagaaaattaagcaatacttcagtgataataaagacgaatggtccgatgtgaaccccaagaaaattaaaatacattatttcacaaaagaaaccaacgaacgatttttcgcaacacgaaaacccttagatacttcattcgacaagaagaaaataaagacgcaagtagctgataccgcgatccagaaaatattgttaaaccacctatcagcacatggagataaagcagaaacagcattttcaccggatggaatagacgagatgaatagaaacatcattgaactgaacgatggaaaattccaccagcctatactgaaagtaagaatttacgagaaagcagacaaatacgccgtaggacaacaaggaaataagaagaagaaatatgtagaagctgccaaaggtacaaacctattcttcgcaatatacgcggaagagaaaatagatgagaaaaccggcgataccgtcataacccgaacatacgactcaatacctttaaacgtagtcatagacagagaaaaacgtggactcagcccagtaccagaaaacgaaaatggagcaaaaccaaaatatgtgctctcccccaacgatcttgtctacgttcccaacgaagaagagagggaaacgggaagaatatgcgaaccattagataaagagagaatatataaaatggtatcatctaacaaaaagcaggctttctttataaaatcagaagtagcaagcactatagtggataaattcgagttcagtgctttgaacaagcaagaaagagcgctcagcggagaaatgattaaagaaatatgtatcccaatatctatcaacagaatcggagaaataactttgagatga

SEQ ID NO: 9236 - RNA, 4554 nt, synthetic construct
  misc_feature 1..4554: note = Cas9 variant
  source 1..4554: mol_type = other RNA
atgaaaaaaatagttggccttgacctcggaacaaactctataggttgggcactcataaacgcgtatataaataaagagcacctatatggaattgaagcctgtgggtctcgaataattccgatggacgcagctattttaggcaactttgataaagggaactcgataagtcaaacagcagacagaacatcatacagagggataaggcgactacgggaaagacacctattgagacgagagagattacaccgcatcctagatcttctaggctttttaccaaaacattactcagattcactaaatagatatggtaaatttctaaacgacatcgagtgcaaacttccctgggtaaaagatgaaacaggctcatacaagtttatctttcaagaatcatttaaagaaatgctagcaaacttcacagaacaccatccaattctgattgctaataataaaaaagtaccatacgactggacaatatattatcttagaaaaaaggctctaacacaaaaaatcagcaaggaagaactcgcatggatactacttaattttaatcaaaaaagaggatattaccaactcagaggcgaagaagaagaaacacccaataaattagtagaatactactcattgaaagttgagaaagttgaagactcaggagagagaaaaggaaaagacacatggtataatgttcatctagaaaacggaatgatatatcgacgaacctctaacatacccctcgattgggaagggaaaaccaaagaattcatagtgacaacagaccttgaggccgatggctcacctaaaaaagacaaggaagggaatataaaacgcagcttccgagcaccaaaagatgacgactggacgttaataaaaaaaaaaacagaagcagacatcgataagataaaaatgacagttggagcgtacatttacgacactctacttcaaaagccagatcaaaagataagaggtaaactcgtaagaacgatcgaacgaaaatactacaaaaatgaactataccagattctaaaaacccagtcagaatttcacgaagaactgagggataaacaattgtatatagcctgcttaaacgaactatacccaaacaacgaaccacgtcgaaacagcataagcaccagggatttctgtcacttattcatagaagacataatattttatcaacgtccattgaaatctaaaaaaagcctgatagataactgcccatacgaggagaacagatacatagacaaagaatcaggtgaaatcaaacatgcgagcatcaaatgcatagccaaaagccaccctttataccaagaatttaggttatggcaatttatagtcaatctgagaatataccgaaaagaaacggatgtagatgtaacacaagaattactcccaacagaggctgattatgtaaccctatttgagtggctcaacgagaaaaaagaaattgaccaaaaggcttttttcaaatatcccccgtttggattcaaaaaaacaacaagtaactatcgatggaactacgtcgaagataagccatacccatgcaatgaaacacatgctcaaataatagcacgactaggcaaagcccacataccgaaagcattcctctcaaaggaaaaagaagaaacattatggcatatcctatatagcattgaggacaaacaggaaatagagaaagcactacattcctttgctaataaaaataatttaagtgaagaattcatagaacaatttaaaaattttccacctttcaaaaaagaatatggatcatactccgctaaagcaattaaaaaactattaccattaatgcgcatgggcaaatattggagcatagaaaacatagataacggaacaagaatacgaataaacaagataatagacggagaatatgatgagaacataagagaacgagttagacaaaaagcgattaatctcaccgatataacccatttcagagctttacccctatggctagcatgctatttggtatacgataggcattctgaggtaaaagatatagtgaaatggaaaacaccaaaagatattgatctttatttaaaaagctttaaacaacactctcttcgtaacccaatcgttgaacaagtgattacagaaaccttacgaaccgtaagagatatatggcaacaggtagggcatatagacgaaattcatatagaactagggcgagaaatgaaaaacccagcagacaaaagagcacgaatgtcccagcaaatgataaaaaatgaaaacactaatttaaggataaaggcactactaacggaattccttaatccagaatttgggatagagaatgtgagaccttattccccctcacaacaggatttactgagaatatacgaagaaggcgtactaaacagcatactagaacttcccgaagacataggaatcattctgggaaaatttaatcagaccgacactttaaaacgaccaaccaggtccgaaatactccgatataagctttggctggaacagaagtaccgatcaccatatacaggagaaatgatacctctaagcaaattatttacaccagcatacgaaatagaacatataataccccaaagcagatattttgacgactcccttagtaacaaagtgatatgtgaatcagaaattaacaaactcaaagacagaagcctcggatatgaatttattaaaaaccaccacggcgagaaagtcgagttagcattcgacaaacccgtagaagtcctctcagtagaagcctacgaaaagctggttcacgaatcttatagtcacaacagatcaaaaatgaaaaaattactaatggaagacataccagaccaattcatagaaagacaactaaacgattcacgatacatatcaaaagtcgtcaaatcattattatcgaatattgtaagagaagaaaacgaacaagaagcaatttcgaaaaacgtaatcccatgcacaggcggaataacagaccgtctaaaaaaagactggggaatcaacgatgtatggaataagatagtactaccaaggtttattcgattaaatgaactgactgaaagtacaagattcacatcaataaacactaacaataccatgataccatcaatgccattggaactacagaaaggattcaataaaaaaaggatagatcaccggcaccatgccatggacgctataataatagcttgcgcaaatagaaacatagttaattaccttaacaacgtgagcgcatcaaaaaataccaaaataacaagacgtgatttacaaaccttgttatgtcataaagacaaaactgacaacaacggaaactataagtgggtaatcgacaagccctgggaaacattcactcaagacacactaacagcactacaaaaaataacagtttcttttaaacaaaaccttagggttattaacaaaacaaccaaccattaccaacactatgaaaatggaaaaaaaattgtatccaatcaaagtaagggagattcttgggctatacgtaaaagcatgcataaagaaactgttcatggagaagtaaacttaaggatgataaagacagtaagtttcaatgaagctttaaaaaaaccccaagcaatagtagaaatggacctaaaaaaaaaaatattagctatgctagaacttggatacgacaccaaacgaataaaaaattacttcgaagagaacaaagacacatggcaagatataaatccaagcaaaataaaagtatactatttcacaaaagaaactaaagatcgatactttgccgttaggaaacctattgacacatctttcgacaaaaaaaaaataaaagagtcaataactgatactgggatccagcaaatcatgttaagacacctagagaccaaggataacgatccaacattagcattcagcccagacggaatagacgaaatgaataggaacatactaatactcaataaaggtaaaaaacaccaacctatatataaggtcagagtctatgaaaaagctgaaaaattcactgtaggccaaaaaggtaataaacgcacaaagtttgtcgaagccgcaaaaggaactaacctattctttgccatatacgaaacagaagagatcgacaaagatacaaaaaaagtgatacgtaaacgttcttactccacgattccactgaacgtagttatcgaaagacaaaaacaaggcctatccagtgctccagaagacgaaaatggaaatctaccaaagtatatcctaagccccaacgacctagtatacgttccaacccaagaggaaatcaacaaaggggaagtcgtaatgccaatagatcgggacagaatttacaaaatggtggactctagcggaataacagctaacttcataccagcatcaactgcaaatctaattttcgcattacccaaagcaacggcagaaatatactgtaacggagaaaattgcatccaaaatgaatacggaataggaagtcctcaatcaaaaaatcaaaaagccataaccggagaaatggtcaaagaaatatgtttcccgataaaagtcgacagactcggaaatattattcaagtaggatcatgtattttaacgaattga

SEQ ID NO: 9237 - RNA, 4563 nt, synthetic construct
  misc_feature 1..4563: note = Cas9 variant
  source 1..4563: mol_type = other RNA
atgaagaaaatagtgggattggaccttggtactaacagtatcggatgggccctaataaatgcttacatagacgaatataataaagaacatctctatggaatagaggcctgtggatcaagaataataccaatggatgcagcaatattaggaaacttcgacaaagggaatagcatttcccaaacagctgaccgaacatcatatagaggaataagaagacttcgagaacgacatttactacgccgtgaaagactacacagaatactcgatttactaggattcctaccaaagcactactccgatagcttaaatagatacggtaagttcctaaacgatattgaatgcaaacttccctgggtaaaagacgaaacaggatcctataaattcatttttcaagagtcgtttaaagaaatgttagcaaatttcacagagcaccacccgatcctcattgctaacaacaaaaaggtcccatacgactggacaatttactatctcagaaaaaaagctcttactcaaaaaatatccaaagaagagctagcctggattttattgaactttaaccagaaaagaggttactaccaattacggggagaggaagaggaaacaccgaacaagttagtagaatactactctttaaaagtcgaaaaagtggaagatagtggcgaaagaaaaggaaaagacacctggtataatgtccacctcgaaaatgggatgatatatagaagaactagtaatatacctctagattgggagggtaagacaaaagaatttatagtcacaacagacctggaggcggacggttcgccaaaaaaagataaagaaggcaatattaaacgatcattccgagcaccaaaagatgatgattggacacttataaaaaaaaaaacagaagcagacattgataaaataaaaatgacagtcggggcatatatctacgacacgctactccaaaaacctgatcaaaaaattagaggaaaactagtaagaacaatcgaaaggaaatattataaaaatgaactgtaccaaatattgaaaacccaatccgaattccacgaagaactacgagacaaacaactttacatagcatgtctaaacgaattgtatcccaacaacgaacccagaagaaatagtatatcaacccgtgatttctgtcacctcttcatagaagacataatcttctatcaaagaccgcttaaatctaaaaaatccttaatagacaattgcccatacgaagaaaacagatatattgataaggaatcaggtgaaataaagcacgcttcaatcaaatgtatcgccaaatcccaccctctctatcaggagtttaggctttggcaatttatcgtgaacctacgaatataccggaaagaaacagatgtagatgtcactcaagaattattaccaacagaagccgattacgttacactattcgagtggctcaacgaaaaaaaagaaatcgaccaaaaagctttcttcaaatatcccccctttggattcaaaaaaacaacaagtaactatagatggaattacgtcgaagacaaaccctacccatgtaacgaaacacacgcccagattatagccagactaggaaaagcacatatccccaaggcattcttatccaaagagaaagaagaaactttatggcatatcctatactccatagaggataagcaagaaatcgaaaaagcgctacactcatttgcaaacaaaaacaacctttcagaagaattcatagaacaattcaaaaatttcccaccctttaaaaaagaatatggtagctacagtgctaaagccataaaaaaattgttacccctcatgagaatgggcaaatattggtcaatagagaacatagacaatggtacaagaataagaataaacaaaatcattgacggagaatatgacgaaaacatacgagaaagagtacggcaaaaagcaataaacctaacagatattacacacttcagagcattgccactatggcttgcatgctatttagtctacgatagacactccgaagtgaaagacatcgtcaaatggaagattccaaaagatatcgatctgtatctaaaaagtttcaaacaacattcactgcgaaacccaatcgttgaacaggtcatcacagaaacattacgaacagtaagagatatctggcagcaggtaggacacatcgacgaaatacatatagaattagggagagagatgaaaaacccagcagataaacgtgcacggatgtcacaacaaatgattaaaaatgaaaacacaaatttacgaattaaagcattacttacagaattcctaaatcccgaattcggaatagaaaacgttcgcccatatagcccatcacaacaagatctcctgaggatatacgaagagggtgttttaaacagcattcttgagctacccgaagacattgggataattttaggtaagttcaatcaaactgataccctaaaaagacccacgagatccgaaattctccgctacaaattatggctagaacagaaatacagatcaccatacactggtgaaatgataccactttcaaaactattcacacctgcatatgaaattgaacacataattccccaatcaagatatttcgatgacagtttatctaacaaagtaatatgtgaatccgaaattaataaattaaaagaccgaagcttaggatacgaatttatcaaaaatcaccacggagaaaaagtcgaacttgcatttgacaaacctgtagaagtgctttcagtagaagcatacgaaaaattagtacatgaatcatactcccataaccggtcaaaaatgaaaaagctactaatggaagatatcccagatcaatttatagagaggcaattaaacgactcaagatacatcagtaaagtagtgaaatcattactcagtaacatagtccgagaagaaaatgaacaagaagcaatcagcaaaaatgtaataccatgcacgggaggcataactgaccggctaaaaaaagattggggaataaatgacgtatggaacaaaatcgtattgccacgctttatacgcttgaacgaactaacagaatcaacacgattcactagcatcaataccaacaataccatgatcccttctatgccactcgaactacaaaaagggtttaacaagaaacgtatagaccatcgacatcacgctatggacgccataataattgcctgtgcaaacagaaatatcgtcaattacttgaataatgtttcagctagcaaaaacacaaaaatcacacgtagagacctacaaacactattatgtcataaagataaaacagacaacaacggtaactacaaatgggttatagacaagccatgggaaacattcacacaagacacactaacagctttgcaaaaaatcactgtatcgttcaaacaaaacctcagggtcataaataaaactacaaaccattatcagcattacgaaaatgggaaaaaaatagtaagcaatcaaagcaaaggcgacagttgggcaataagaaaaagcatgcacaaagaaaccgtacacggtgaagtcaatctacgaatgattaaaacagtatcttttaacgaggcactaaaaaaaccgcacgctattgtcgaaatggatcttaaaaaaaaaatcctagctatgttagaactcggttatgacacaaaacgaatcaaaaattacttcgaagaaaacaaagacacatggcaagacataaacccctcaaaaataaaagtctactactttacaaaagaaacgaaagatagatattttgcagttagaaaaccaatagacacatcattcgataaaaaaaaaatcaaagaatcaataactgacaccggcatccagcaaattatgctacgacatttagagacaaaagacaatgacccgacactcgctttcagcccagatggaatagatgaaatgaacagaaatatccttatactaaacaaaggaaaaaaacaccaacccatttacaaagtacgcgtatatgaaaaggcagaaaaattcaccgttggacagaaaggcaacaaaaggactaaatttgtagaggcagctaaaggcacaaatctcttcttcgcaatttacgaaactgaagaaattgacaaagatacaaaaaaagtaataagaaaaagaagttactctacaataccattaaacgtcgtaatcgaaagacaaaaacaaggcctttcctctgcaccagaagacgaaaacggaaacttaccaaaatacatcctttctccaaacgaccttgtttacgtaccaacacaggaagaaataaataaaggagaagttgtcatgccaatagacagagaccggatatataagatggttgactcttcagggataactgcgaatttcatacccgcatccacagcaaatttaatttttgcactaccaaaagcaacagcagagatttattgcaatggtgaaaactgcatacaaaacgaatatggcatcggatccccacaatccaaaaatcaaaaagctattacgggagaaatggtaaaagaaatctgtttccctataaaagtcgacaggctaggcaatattatccaagtaggatcctgtattttaacgaattga

SEQ ID NO: 9238 - RNA, 4563 nt, synthetic construct
  misc_feature 1..4563: note = Cas9 variant
  source 1..4563: mol_type = other RNA
atgaaaaaaatagtgggattagacctgggtacgaacagcatcggttgggcactaataaatgcctacatagatgaatataacaaagaacacctctacggcatagaagcctgcggatctagaataatcccaatggacgcagccattttaggaaacttcgataaaggaaacagcattagtcaaactgccgatagaacctcttatcgcggtataagacgcttgagagaacgacatctcctgaggcgagagcgtttacacagaatcttagacttattggggttcctgccaaaacactattcggattcactcaatagatatggaaaatttttaaatgacatcgaatgcaaactcccatgggtaaaagacgaaactgggagttacaaattcatcttccaggaatcatttaaagaaatgctggctaattttacagaacaccacccaatattaatcgccaacaataaaaaagtaccatacgactggaccatatactatctacgcaaaaaagccttaacacaaaaaatatccaaagaagaactcgcatggatattacttaattttaatcaaaaaaggggctattaccaattacgaggcgaagaggaagaaacaccaaacaaactagtagaatactactctttaaaagttgaaaaagtagaagactcaggagaaaaaaaaggcaaagacacgtggtacaacgtacacttagaaaatggaatgatatacagaagaacctcgaacatacccttagactgggaaggtaaaacaaaagaatttattgtcacaactgatttagaagccgacggatctccaaaaaaagacaaagaaggtaacatcaaacgaagtttcagggcaccaaaggatgatgactggacacttattaaaaaaaaaacggaagccgacatagacaagataaaaatgacagtaggagcatacatttatgacacattacttcaaaaaccggaccaaaaaataagagggaaactagtaagaacaatcgaacgaaaatattataaaaacgaactatatcaaatattaaaaacacaatccgaattccacgaagaactacgggataaacaattatacatagcctgtctcaatgaactctaccccaacaacgaacctagaagaaacagcataagtacacgagatttctgccacttattcatagaagacataattttttaccaaaggcccttgaaatcaaaaaaatctttaatcgataactgtccttatgaagagaatcgctacattgacaaagaatccggagaaataaaacatgcctccataaaatgcattgcaaaatcacatccgttatatcaagaatttcgcctctggcaatttatagttaatctgagaatctacagaaaagaaaccgatgtcgatgtaacacaagaactactgccaacagaagcggattatgttacgctatttgaatggctcaatgaaaaaaaagagatcgatcaaaaagcattttttaaatatccgcccttcggctttaaaaaaaccacaagcaattaccgatggaattacgtagaagacaaaccttacccctgtaatgaaacacacgcacaaataattactagattaggaaaagcccatataccgaaagcatttcttagcaaagaaaaagaagaaacactatggcatatcctttattctatagaagataagcaagaaatagaaaaagcactccactcatttgctaacaaaaataatctgagcgaagaattcatagaacaattcaagaatttccccccatttaaaaaagaatatggctcgtattcagcgaaagcgataaaaaaattattaccactaatgaggatggggaaatattggtccataaaaaacatagacaacggcacacgcataagaatcaacaaaataattgacggagaatatgatgaaaacataagagaaagagtacggcagaaagcgatcaacctcaccgacataacacatttcagagctttacccttatggctcgcttgttacttagtatatgaccgacattcagaagtaaaagacattgtaaaatggaaaacacctaaagacatcgatctctatctgaaatcattcaaacaacattctctaagaaacccaatagtagagcaggtcataacggaaacactcagaacagtaagagatatttggcaacaagtcggacacatagacgagattcatatagaactcggccgagaaatgaaaagcccggccgacaaaagagcaagaatgtcacaacaaatgatcaaaaatgaaaacacaaacttacgtataaaagctctccttacagagttcctgaacccagaatttggaatcgaaaacgtacgaccctatagcccgagccaacaagacctcctcagaatctacgaagagggagttctaaattcaatattagaattaccggaagacatagggattatccttgggaaattcaatcaaaccgacacacttaaaagaccaacgcgtagcgaaatattaagatataaactctggctagaacaaaagtacaggagcccatacacaggcgaaatgattccgttatcaaaactatttacaccagcatatgaaattgaacatattataccacaatcacgatactttgatgactcactctcaaacaaagtaatatgtgaaagcgaaatcaacaaacttaaagacagatcattaggatacgaatttattaaaaaccaccacggggaaaaagtagagttggcatttgacaaaccagtagaggtactcagtgtagaagcttatgagaaattggtccatgaaagctattcccataacagaagtaaaatgaagaaactattaatggaagacatcccagaccaatttatagagagacaactcaacgatagtcgatatatatcgaaagtcgttaaaagtttactcagcaacattgtgcgagaagaaaacgagcaagaagcgatcagtaaaaatgtaatcccctgcactggaggaataaccgacagattaaaaaaagactggggaataaatgacgtctggaataaaatagtattacccagattcataagattaaatgaactaacagaaagtactagattcacatccataaacaccaacaatacaatgattccaagtatgccattagaattacaaaaaggctttaataagaaaagaatcgatcacagacatcacgcaatggatgccataatcatcgcatgtgctaatagaaacatagttaattatctaaataacgtatccgcatccaaaaatacgaaaatcacacgccgagatttgcaaacattactatgtcataaagataaaacagataacaatggcaattacaaatgggtcattgataaaccctgggaaaccttcactcaagacacattaacagcacttcaaaaaataaccgtcagcttcaaacaaaatctaagagtaataaataaaaccaccaaccattatcaacactatgaaaatggaaagaagatcgtgtcaaaccagagtaaaggagattcttgggcaataagaaaatctatgcataaagaaacagtacatggagaagtcaacctacgaatgatcaaaacagttagtctaaacgaagcattaaaaaaaccacaagctatagtagaaatggatctaaaaaaaaagatacttgctatgttagaactagggtacgacacaaaacgaatcaagaattattttgaagaaaacaaagatacatggcaagacattaacccatccaaaattaaggtgtactacttcacaaaagaaactaaagatcgctacttcgccgtaaggaaaccaatcgacacttctttcgataaaaaaaaaatcaaagaaagtataacggacacaggaatacaacagataatgttacgtcacctagagacaaaagataatgacccaaccctagccttctcacctgatggcatagatgaaatgaacagaaacatactaatcttgaataaaggtaaaaaacaccagccaatatacaaagtacgagtttacgagaaagccgaaaagtttacagtaggtcagaaaggtaacaaaagaaccaaatttgtagaagcggcaaaagggactaacttgttctttgccatctacgaaactgaagaaatcgataaagacacaaaaaaagttatcagaaaacgttcatatagcactatcccactcaacgtcgttatagaacgccaaaagcaaggcctatcctccgctccagaagacgaaaatggaaatcttccaaaatatattctttcgccaaatgacttagtatacgttcctacccaagaagaaataaacaagggagaagttgtcatgcccattgacagagacagaatttataaaatggttgactcttccggaatcacagcaaatttcatccccgcgagtacagcaaacctcatatttgcattacctaaagcaaccgccgaaatatactgcaatggcgaaaattgtatccaaaacgaatacgggataggcagcccccaatccaagaaccaaaaagcaataacaggagaaatggttaaagaaatatgtttccctattaaagtcgacagattaggaaatatcatacaagtaggaagctgtatactcaccaattga

SEQ ID NO: 9239 - RNA, 4575 nt, synthetic construct
  misc_feature 1..4575: note = Cas9 variant
  source 1..4575: mol_type = other RNA
atgaacaaaatccttggactagacctaggcacaaattcaataggttgggcaatagtacagaaagatgaacaaggtttttatgagaaaataatcaacgcaggatccagaataatacccatggatgcagaaacaatgaacaatttcaataaaggaattacaaaatcacccgcttcagaaaggactaggttcagaggagcaagaaggctaatagaaagatctctactacgacgagaacgaatacatcgactattaaatacgatgaactacctaccaccacactatgcagagaaaatagattttgtgaacagattgggaaaatttataggcgaagaagaaccaaaatacgcatataaagtagatgaacatggcaaattccaattcatctttaaagaatcctttaatgaaatgttaaaggacttccaagacaaacagcccgaactggtattaaataataagaaagtaccatacgactggacgatatactatctacgcaagaaagcattaaacagagctattagcaaagaagagttaggatggataatactacagttcaataacaaaagaggatattatcaactaagaggagaagaagatgaaactctaaccgaaggccaaaagaaagaatactttgctctaaaagtgataagagttgaagcagattcctccagcgcagggaagaaaggagaagtatggtataacgttcaacttgagaacggatggatatacagatgtaaatcagaaataccattggactgggagggaaaaataaaagagttcatagtaacaaccgaagtcgatgaaaatgacaacgtattaaaagacaaagaaggaaaagaaaaacgtaaactaaaaataccagaagcgggtgactggacactactgaaaaagaaaacagaaagtgacttagacaaaagcggaaaaactgtcggtgcctacatttacgacactttattgagcaacccagaccagaaaatcaaaggagggttaataagaactatagaacgtgaactatacagatcagaacttgaacaaatattagataaacaaaaagagttccaccccgaactaaaagacggaacgctatacaataaatgcgtagaagaactataccgcagcaatgaaagtagaagaatatcactcagcaactacgactttacgaggtttattacagaagatgttatattctatcaaagaccactaaaatcaaagaaatcgcttatagataattgttcatttgaaagacgaaattacttaaacccaattacaaaagaactagcctacgcgcccataaaatgcattgccaaatcacaccccctattccaagagtttagattatggcaatttattaaaaacctaagaataattgaaagagagaaaatcgtcggtgataaactcatgttcgatcaagacgtcaccacagaatttttacctactcaaaacgattacgtgatactttttgactggttgaatgaacataaagaaatcgatcaaaaagccctactcaaatacccagcatttaatctgaaaaagaatatcgataagtacagatggaattatgtagaaaataaaagttacccgtgcaacgaaacacgagcactattaaaagcgaaactaaataaagcgggaaatatcccatcagatttcttagataatgacaccttggagtccctgtggcacatactctatagtgtggaagataaatttgaaatagagaaggccctaaaatcattcgccacaaagaaagaattacgggaagaacaaacagtagcattcgtaaaacaattcataaacatacccccatttaagaaagaatatggaagttattccgcaaaagctatcaagaaactgctacagctcatgagaatgggctcaaggtggtcagaaaatgaaatttctgattcaaccaaagaccgaatacaaaaactaattgacggtgaatgggacgaatccataaaaactagaacaagagataaagccatcaaactaaatgaaataaatgatttccaaggactgcccctatggctagccagttatatagtttatgaccggcactcagaatctggagatgttatgaaatgggaaaccccagaagacatcgattactacctgaaacacgttttcaaacaacacggcttacgaaaccctatagttgaagtcgtagtcgttgagaccttaaaggtagttaaagatctctggaaaacctatggctatttcaacgaaattcacattgaacttggaagagagatgaaaaacccggcagataaacgaagatctatgacaaataagaatatagaaaatgaaaatacgaatcttagaataaaagccttattagctgaattagcaaaccataaagatgtagaaggcgtacggccatattcaccaagccaacaagaaatcctgaaaatatacgaagaaggggtccttgatatgctaacgaaagaggaccctgattacgaatcgatatcaaaaataagcaaaatggcactaccatcatcaagtgaactcataagatacaaatgttggctagaacagaaatacagaagcccatatacgggacaagtaatacccttagcaagattatttaccagcgagtacgaaattgagcatataataccacaatcacgttacttcgacgatagcttctctaacaaagtaatatgtgaaagtgccgtcaacaaagataaagacaacctactagcgtatgagtatataaagcaaaatgaagggaaaataatagaaatcggactcggaaagaaggttaaattattcactgccgactcctatacagaatttgtgcaaagtaattatgtaggatcagtagctaaaaagaagaaactcttaatggatacaatcccagactcgtttataaaaagacaactaaacgattcgagatatatatcaagagagataatgaaattactaagctctgtggttcgcgaaaaagaagaggaagaagaagaggaagaagaagaagcaataagtaaaaacgtcattgtctgcaccggagcaatcacggacaaattaaaaagggaatggggacttaacgatgtatggaacacaataatctaccctcgctttgaacgattaaatcaacttacaaacagcgataaattcggacaatgggaaaataaacaaggcaaaaaggtatttcaaatagaaatgcctttgaaacttcaaaaaggattcaataagaaaagaattgatcacaggcatcatgcaatggatgcaatagtcattgcatgtgcaacacagagccatgtaaattatttaaacaacgaatcagcacacagtaacagtaaagaaaaacgatattacttacgtagaaaactgagaagaattgagattctagagaaacaagagttaaaagacggagtaacaataacgaagaaaatagaagtagcgaaagaatttaacaaaccatggccgacatttacacaagacgcacatgaagtactacaatcaatcatagtgtcattcaaacaaaatctacgggtagtgaacaaagctacaaaccgatatgcatgctttgttaacggaaagaaagaaatcgtaaaacaaagtaaaggagaaagctgggcgatacgaaaacccatgcataaagatacagtaagcgctgcggtctcactaaggaaaataaaaacagtcagtttatcccaagccatcgacgactggacgaacatagttgacaaatcactaagaaaagaaataggactactgtatagtaaatacggacagaacggaagcaaaaatatcataaaatatttcaaagatagagataataaacacaacgggctagatgtttcaaaagtaaatgtacactacttcgacaacgactatgcggcctcaagagtagctttagaccacaagttcaactcagcgaaaataaaatcaataacggacacaggcatacaaacaatactactcaaacatctagaatcatataatgagataaatggggacaagataatagagcacccagagcttgccttcagtgccgacggattagacattctgaatgcaaatattacaaaactaaacaacggaaaattccataaaccaataaagaaagtacgtaaaactgaaacactaggattaaaattcatagtaggacaaacaggtaataaaagaaagaaatacgtagaagcagcagatggaaccaatctattctttgctatatatgtgagtgtagatggcataagatcctataaaacaataccattgcgtgaggtagccgagagactaaaagaaggcctaatacccgtgccagagaaaaatgataaagacgaccacttactattctggcttagtcctggagatttagtctacgttccaagtatcgaagaagaaggtagaattgtcgaaatagaaaatataaaacaagacagaatatacaaagtagttagttgcacagagaatgaatgccactgtattcctcatttcgtcgctagtcccatagttaaaacagatgaactcggagctaacaataaagctcaaagggcgtggtctggagaaatgattaaagaaacatgcataaaaataaaaatgaatcgtcttggacaaattgtgaaaatctga

SEQ ID NO: 9240 - RNA, 4581 nt, synthetic construct
  misc_feature 1..4581: note = Cas9 variant
  source 1..4581: mol_type = other RNA
atgaagaagatattaggactagacttgggcacaaattcaataggatgggctgtgttaaacgcagccgatgacaacagcctcaaatatatcgaagccgcaggaagcagaattataccaatggacgcagccatattaggggatttcgaccgaggtaattcaatatcacaaactgctgaaagaaccagaatccgaggaatgagacatttaagagaacgatacctccttaggagagcgagattacatagaattttaaaccttcttggattcttaccattccactacgcacaagacatagatagatacggaaatttcagtgcagacatggaaccaaaaatagcatggcgtaaaaatttagaaggagaattggagttcatttttattgaatcatttaatgaaatgttagaagattttcgaaagaaccaaccagagctagtagctgacaacaagaaagtgccatacgactgggttatatactatctaagaaagaaagcattggaaaagaaaatctcaaaagaagaactagcgtggatcctactaaactttaatcagaaaagaggctattatcaactaagaggggaagacgatgatgaatcaatgaaaaccgcaaaaacacgacaatacttcgataaacaaataatcaaaaacatcatagatacaaaccaaacatataaaggtcaacgaatcctaatagtagaacttcaaaatggtgacaaaggtaaaatcttcaagaaagaaatcccagactggataggacaagagaaaaatataatagtaacagtggatatagataaagacggaaacgacaaatatgaagaatcagggagtttatcatgcaggttcaaaattccaacagatgcagaatgggaatccgaatggaaactaataaaaatgaaaactcaaaaagatctagatgaatcaaacaaaactgtaggaacctatatatatgacagtatcctacaaaacccaacacaaaaagtgagagggaaattagtacgcacgatagaaagaaaatactataaagccgaactaaaacaaatcctagaaaaacaaactgagttccacagcgaattacaagataaagatctatatatagaatgtctcaacgaattatattccaacaacgacacacacagaaacgcaattaccgatagagactttgtctatctattcatgaacgatatactattctaccagaggcccctcaaatcaaagaaatctttaatagataattgcccatatgaacgcaatatatatatagacaaagaaaccggggaaatcaaatactcaccaatcaaatgtatagcaaaatcccatcccttatttcaagagttcagattatggaaatttatatcgtcaataagaatataccagagagaaagcgtagtagaggtggtcgacaaacaattagatttatttagtagccaatctacatcagttcaaaaattagttaccgatgtagacgtgactgacaaatttttgacatgcgagaatgactacgttgctctatttgaatggctcaacaaaaagaaaataatagaccaaaaagaatttttaaagtacaggccattcggattaaaaggagacatagacaattatcgatggaactatgtggaggacaaaagctatccatgcaatgaaactcatgcaatgatactgacctactttgcaaaagcaggaatatcagaagacatactaacaaaagaaatggaggaagcattatggcatatactttattccgtagaagatagacaggaaatcactaaagcactacgaacattcgccagtaagtatcatttatcagactcttttgttaaggtcttcagtaacataccaccatttaagaaggaatatggaagctatagcgcaaaagcaataaagaaactcctgtcgcttatgagaatgggtaaatattggtcagaagatgctatcgacgtcaatacccgagaaagaatagacaaaatagtcaccggagaatatgatgagaaaatccgagacagagttagagagaaaaccatacgactaaacgacatccgacacttccgcgcgttacctgattggcttgcatgctacgtagtctacgaccgacacagtgaaactcgagaaatcacagaatggaaatcacccgaagaaattgacgaatatataagaaactttaaacaacattccttacgtaatccaatagtcgaacaagtgattacagaaacattgagaacagtaagggatatatggaaacaagtgggttgtatcgacgaaattcacgtagaattaggtagagaaatgaaaaatccagcagacaaaagaaaacggatcacgtcacagataattgaaaatgaaaacgcaaacctaagagttaaagcactcttaacagaatttgtaaaccctgagttcgaaatagaaaacgtaagaccatatagtctcggacagcaagacatactaagaatatatgaagatggagtcctcaacagcgttgcagaagtaccaggcgacatcgctggtatactgaagaaattcaatgaaaatgacgcaaagaaacgtcctacaacgtcagaaatactaagatacaaactgtggctcgaacaaaaatatagaagtccctacaccggtgagatgataccattgagtaaactgtttacaagcgcttacgaaatagaacacgtaattccacaatccaggtatttcgacgactccttctccaataaagtaatatgtgaagcagaagtcaataaattaaaagataacgctctgggttatgagttcattaaaaagcaccacggtgaaaaagtagaactcggatttggaaaaattgtcgaaatatttagcgtgtcagtatacgaacaatttgtaaaagacaattattcacgaaaccgaggcaagatgaaaaagttattaatggacgaaattccagaacaatttatagagagacaattaaatgactctcgatatatcagtaaagtagtaaaaaccttattaagtaacgtagttagagaaaaagcagaacaggaggcagtatccaaaaatgtcatagtttgcacgggcggcgtaactgatcgcttaaagaaagactgggggataaacgacgtttggaacaagattgttctaccaagattcttacgacttaatgaattaacaaactcaactaacttcacagccaaaaacgccgcaggaaacgagatacctgctatgccattggaactacagaaaggtttcaacaaaaagagaatagatcaccggcaccatgcaatggacgcgatagttatagcatgcgctaatagaaacatcgttaattacttgaataatgaatcagcctcacgcaaagctaaaatatccaggcatgacttacaagctatactctgcgacaaagtcagaacagacgacaaaggaaactaccaatggcgagtcaagaaaccctgggatacctttacacaagacgtatacgtagcacttgagaatatcattgtatctttcaaacaaaatttaagagtaatcaacaaaacatccaactactattggcattatgaaaacggaaagaaagtattagtaaaacaagtaaaaggtgattcatgggcaataagaaaacccatgcataaagacacagtgtttggagaagtcaacctacgaaaggtcaaatccgtgagcttaaacgaagccctcaaaaatccccaattcatagtagaaaaagacctaaaacgacaattactaagcctactacaacaaaacttcgatataaagaaaattaagaaatacttcgaagaacataaagacatatggagcgatattagtctatcaaaaatgaatatatattacttcacaaaagaaacaaaagaccgatacttcgctacacgaaaaccattagatgcaagtttcgacaagaagaaaattgaaagttgcataacggatactggaatacaacaaatactcctaagacaccttgaactaaaagaaaacgatcctgaaagagcgttttctccagatgggatagatgaaatgaatagaaatataatccaactaaacaaaggaaaaggccatcaccccatagcgaaagtcagagtttatgaaaaagcagataaatttgaagtaggtcaacgtggaaacaaaagttctaaattcgtagaagcagcaaaaggtacaaacttatttttcgcggtatacgaaactgaataccccgatgagaaaactaactccatagtacgcaaaaggaattacgcaaccataccactaaacattgccatagaacgccaaaagagaggcctctcgacagcaccagaagacgaaaaaggcaacgttccctcctttgtactaagcccgaatgatttagtatacctacctacatcagaagatattgtcaatggtcacataacacaacctatagataaatcaaggatatacaagatggtatcatcttcaggcagtcaatgcttctttataaaacacaatatagcaaacattattgtagacaaatacgagttcagcccattgaataaaatggaacgtgcaatttcaaacgaaatgatcaaagagatatgcataccagtcaaagtcgatagactaggtaacatagtcaaacttggaaagagtgaatga

SEQ ID NO: 9241 - RNA, 4581 nt, synthetic construct
  misc_feature 1..4581: note = Cas9 variant
  source 1..4581: mol_type = other RNA
atgaaaaaaattctaggacttgatctagggacaaactcgataggatgggcggtcctaaacgcagcagatgacaattcattaaaatatatagaagctgctggaagtcgcataattccaatggatgctgcaatactaggagatttcgatagaggtaacagtatatcacagactgcagaaagaacgagaatacgaggcatgagacacttaagagaacgctatctactaagacgagcaagattacacagaatattaaacctattgggatttctaccgtttcattatgcgcaagatatcgatagatacggaaatttttcggctgatatggagccaaaaatagcctggtgcaaaaatttagagggtgagttagaattcatatttatagaaagttttaacgaaatgttagaggacttcagaaaaaatcaacctgaactagtcgcagataacaagaaagtaccttatgactgggtaatatactatctaagaaaaaaagccctagagaaaaaaattagcaaagaagaactagcgtggatactattgaattttaaccaaaaacgtggatactatcaactaaggggggaagatgatgacgaatcgatgaaaaccgcaaaaacaaggcaatatttcgataaacaaataattaaaaatattatagatacaaaccagacatataaaggacaacgaatactaatagtcgaactacaaaacggcgacaaaggaaaaatcttcaaaaaagaaattcccgattggataggccaagaaaagaatataatagtaacagtagacatagataaagatggaaacgacaaatacgaagaaagtggaagcttgagttgtcgcttcaaaatcccaacagacgcagagtgggaaagcgaatggaaactaataaaaatgaaaacccaaaaagatcttgacgagagcaataaaactgttggcacatatatatatgattctattctccagaatcccacacaaaaagtaagaggcaagttagtgcgtactatagaaagaaaatattataaagcagaattaaagcaaatattggaaaaacagacagaattccatagtgaactacaagataaggacctctacatagaatgcctaaacgaactatactcgaacaatgacacacacaggaacgcaattacagatagagacttcgtatacctattcatgaacgacatactcttttaccagcgacctctaaagagcaaaaaaagcttgatagataattgcccgtacgagcgtaacatctacatagataaagaaacaggtgaaataaaatatttacccataaaatgtatcgctaaatcccacccattattccaagaattccgcctatggaaatttataagttcaattagaatttatcaaagggaaagcgtagttgaagttgtggacaaacaactggacctctttagttcacaatcaacatcagtacaaaaactagtaacagacgtcgatgtcacagacaaattcttaacctgtgaaaatgactacgtagccctattcgaatggttaaacaagaaaaagattatagaccaaaaagaatttttaaaatatagaccttttggcctcaaaggggatatagataactatagatggaattacgtagaagacaaatcatatccatgcaacgaaacgcatgcaatgattttaacatactttgcgaaagcaggaataagtgaagatatcctgacgaaagagatggaagaagctttatggcacatactatactcagtggaagacagacaagagataactaaagcattacgaaccttcgctagcaagtaccatttatcggattcgttcgtaaaagttttttcaaatataccacccttcaaaaaagaatatggaagttatagtgcaaaagccattaaaaaattattatcattaatgagaatgggaaaatattggtccgaggatgcaatcgatgtaaatacacgtgagaggatagacaaaatagtaactggcgaatatgacgaaaaaattagagatagagtccgtgaaaaaacaataagattaaatgatatccgacattttagagcgctacccgactggttagcctgctacgttgtatatgacagacattcagaaacgagagaaataactgaatggaaaagccctgaagagatcgatgaatacataagaaattttaaacaacattcattgagaaaccctattgttgaacaagtaatcaccgaaactttacgaaccgtacgtgacatatggaaacaagttgggtgtatcgatgaaatacatgtagaactgggaagagaaatgaaaaaccccgcagacaaacgaaaacggataacatcacaaatcatagaaaatgagaacgccaatttacgagtcaaagcactattaaccgaattcgtaaacccggaatttgaaatagaaaacgtccgcccatatagcctaagccaacaagacatattacgaatttatgaagacggagtgcttaatagtgttgctgaagtccccggagatatcgcaggcatactaaaaaaatttaacgaaaacgatgcgaagaaaagacccacaacgtcagaaattcttcgttataaactatggctagagcaaaaatacagatccccttacacaggagaaatgatacccctttccaaattatttacatctgcgtacgaaatagaacatgtgataccacaatctagatactttgacgattcattttcaaataaggttatatgcgaagctgaagttaacaaactaaaggacaacgcattaggctatgaattcataaaaaaacaccacggagaaaaagtagaattaggattcggaaaaatagtagaaattttctcagtttcagtctatgaacaatttgtcaaagacaactactcgcgaaacagaggtaaaatgaaaaaattattaatggatgaaattcccgaacagtttattgaacgacaattaaatgactcacgatatataagtaaggttgtaaaaacactactttccaatgtcgtacgagagaaagcagaacaagaagcagtgtcaaagaacgtaattgtatgcacaggaggagtgacagatcgattaaaaaaagactggggaataaacgatgtctggaacaaaatagtacttcctcgattcttacgacttaacgaattgactaacagtactaatttcaccgcgaaaaacgcagccgggaacgaaattccggccatgccacttgaactacagaagggatttaacaaaaaaagaattgatcaccgccatcatgcaatggacgccatcgtaatagcctgtgctaaccgaaacatagtcaattatttgaataatgaaagcgcctcacgaaaagccaaaatctcaagacatgatctccaagcaatcttatgtgataaagttcgtactgatgacaaaggtaactatcagtggagagtcaaaaagccatgggacactttcactcaagacgtgtacgtagccttagaaaatattatagtatcattcaaacaaaacctccgagtaattaacaaaactagcaattattactggcattatgaaaacggaaaaaaagtcctcgtaaaacaagtcaaaggcgattcatgggccattaggaaacccatgcacaaagatacagtctttggagaggtaaatcttagaaaggtaaaaagtgtatcattaaatgaggcgctaaagaatccccaattcatagttgaaaaagatctcaaaagacaattactgtccctgttacaacaaaactttgacataaaaaagataaaaaagtactttgaagagcacaaagatatctggtcagacatcagcctatctaagatgaacatttactatttcacgaaagaaacaaaggacaggtactttgccacaagaaaaccgttagatgcgagctttgataaaaaaaaaatagaatcatgtattaccgacacaggtatacaacaaatactattaaggcacttagagttgaaagaaaacgatccagaaagagcttttagtcctgacggaatcgacgaaatgaataggaacattatacaacttaataaaggaaaaggtcaccatccgatagcgaaagtaagagtttatgagaaagcagataaatttgaagttggacaaagaggtaataaatcttctaaattcgtagaggccgcaaaaggaacgaacttgtttttcgcagtttacgaaacagaataccctgacgaaaaaaccaactccatcgtcagaaagagaaattacgctacaataccactgaacatagccatagaaagacaaaagcggggactcagtacagcacctgaagacgaaaagggtaacgtaccatcctttgttcttagccctaacgacttagtttacctccctaccagtgaagacatagttaatgggcacattacacaaccgatagataaatcaagaatttataaaatggtcagtagtagtggatcccaatgtttctttataaaacacaacatcgctaacataatagtagataaatacgaattttcaccattaaacaaaatggaaagagcgataagcaatgaaatgattaaggaaatatgtataccagtaaaagtagacaggctaggaaatatagtaaaattaggaaaatcagaatga

SEQ ID NO: 9242 - RNA, 4584 nt, synthetic construct
  misc_feature 1..4584: note = Cas9 variant
  source 1..4584: mol_type = other RNA
atggccaaaatcctaggtctagacctagggactaattcaataggatgggcaatagtcgaaaaggacggaaacgatttctcattagttgacaaaggcgtaagaatatttagcgaaggagtcaaaagtgaaaaaggaatagaaagttcacgtgcagcagaacgaacaggataccgatccgcccgtaaaataaagtatcgaaggaaactaagaaaatacgaaacactgaaggtactttcattaaacgggatgtgcccattatccatcgaagaagtagaagaatggaaaaagtcaggatttaaggaatacccattaaacccggaatttttagagtggttacgaacctcagacgacgaaaacataaacccttacttcttccgagataaagcatcgaaacagaaagtcaccctttttgaagtaggaagagcattttaccatatagcgcaaaggagaggtttcttaagcaacagattagaccaaagcgcagaaggcatattggaggaacattgtccaaaaattgaggccttagttgaagacttgaactcaacagacgaaatattaacctcccttaaagattatttctttgatacgggaatactagatgctaacgaaaaaggaggatttgcaaaggatctagacgaaggtgacaaaaaactcgttagcctgtatagatccattcaagcaatcgtaaaaaagaatgacacagactttgaaaaagggaaagcagaaatcatagagagattaaacaaaaaagatgttttaggcaaagttaaaggaaaaatcaaagacatatcacaagccatgctagaaggtaactttaaaaccttagggcaatatttcttcagcttgtacaataaagaacgaattcgaaaccaatatacgagtcgagaggaccattacttagaggaattcaagataatttgcaaattccaagggataggctcaataaaccaaaacgaaaagctgccagaaaaaaaattcgaaggtctcgcaaaagaattatacaaagctatattcttccaaagaccactaaaaagccagaaaggattaatagggaaatgttcgttcgaaaaaagcaaaagtagatgtgctataagccaccccgattttgaagaaaaaaggatgtgggaatatttaaacacaatcaaaattgggacacaatctgaaaaagtattgcgtttcctatctcaagaagaaaagctaaacttgataccaaaatttctaagaaaaaaagataacttcaattttgaagatctcgccaaagaactaatcgaaaaaggggcaaccttcggattttataaatcgtcaaaacgagacagttttcactattggttcaactataaaccaacagacaccgtaagcggatgtcccgttagcgcgagcctaaaaagcgtagtaggcgaagactggaaaacaaaaagtttcatctacaaaacaacaaacagtaaaggaatagaagttagtcgcacggtaaattataaagacttatggcacttgttatcggtgtctaccagtgatatttacctctatgaatacgccaaaaacaaactaggattagaagataaaaatgcaaaagcattcagtaaaatcaagcttaaaaaggactttggaaatctcagcctgaatgcaatcaacaaaatacttccttacatgagggaaggactcctatatagtcacgctgtattcatggctaatatagagagcatagtagatgaagtaatatggaatgacctaggacaaagaaaatatatacaagacaagatagcagctataattgcgaacaatatagtcgataacggcctgctagaagtagtaaatggactcataaaagaatgcaaagtagacggcgcgtattatagtaaagaagcggccgacacttacagaaaagatttgagcaaaaaactagtaagtttttttaaatttcatcatatagacgatggaatcaaacaagaaacaattttaaatgaactatttccagtattcatcgaacaactaaaagcacatgaattcattaaagttaaaagattagacgaaaaagtacttgaattcctaaaaggggaaaatcaggatggcgaagtattttgtaacaacgcaaaacaattaaaaaaactgtaccacccatcggatatcgaagttttcaaaaaacaaattgtcaaagataaagacggaactgagacaggccaattgattcttggatcaccactaaccagttcaatcaaaaatccaatggcaatgagagcgctgcatcaactaagaaaagtattaaatacattaatagtcgaagaacaagtagattcctccacccgaatccatatagagatggcacgagaattaaatgacgccaataaacgtaaaggaatacaagattaccaaaacgaaaacaaaaaagaacgagagaagtaccgagacgaaataaaaaaattatacttagctgaatgcaataaagaaattgagcccactgtagacgatttactacgatatcagctatggatagaacaagaccgaaaagaaatatacgaaaatggtaattcaatatcaatatgcgatatcataggagacaacccagcatatgatattgaacatacagttccacgtagcataagtcaagataacagtcaaatgaacaaaactctatgttcccaaaaatttaatcgagacgtcaaaaaacagaaaatgccctttgaactcggaaaccacctagaaatactcccaagaatcgcccattggaaggaagaagccgacaacctatccagggaaatcgaaatgattataagatcaactaaaaccgccgctacaaaagaagctaaagacaaaaaaatacgacgaagacattacctcacacttcggagagattatttacaaggcaaatatgataggtttatatggacagaacccaaagtcgggtttaaaaatagtcaaatccccgataccggaataatcacccgatatgcacaagcatatcttaaaagctatttcaacagagtagaaagtgttaaaggtggaatggtagcagagttcagaaaaatttggggtatacaagaatcataccaagaaaacggaaaaaaatattttaaagaaaaagatagaagcaaacacacgcatcacaccatcgatgcaatcacaatagcctgcatgacgaaagacaaatacgacgtattagctcacgcctggacactcgaagataaagaacaaattaccgaagcaagaaaaatagtggcagaatcaaaaccatggaaaacatttaaagaggatctcaaaaaaatagaagaaggaatactggtatcacactacacaccagacaacgtaaagaagcagtcgaagaaaattgtaagagtacgtggaagaaagcaatacgtggctgaaatagaaagggacgttaacggtaaggcggtagcaaaaaaggatatatcaggcaaagtcatttacaagctagacaaagacggaaaaaaattaccaagattacaacaaggcgatacaatacgaggatcattacatcaagactcaatatatggagccataaaaaacccactaaaaacagaggaaatacgatatgtgatcagaaaagacctcgaatccatcaaagcttccgatgtcgataatatcgtagatgaaatggtcaaggaaaaagtaaaagaggctatagcaagtaaagtactgatactgtcctcaaacccacagcaaaaaaacaaaatagacgggaaagtgtggatgaacgaagaaaaaggaattccaataaacaaagtcagactgtatgccaatagcgtaaaaaacccattagaaataaaagaacacagcagcctaagcaaaagtagacacgagcataaacaaaaggtatacggacagaatgatgaaaacttcgcaatggcaatctacgagggcctagataaaaaaggtaaaaccgaaagagcgtttgaactaataaactacatggatgcgggctactattataaactgaaaaacaaaaacgaaaggaaaaaagatataatttctttagttcccgaaaaacacatcgaaaccggattcaatctattaagaagcaacaagataccaataattcttaaaaaaggacttaacgttattctatataaaaacgaaaaagaagaaatagactttaataatcccaacagtataattaaaagattatataagatcagcggtctagacaaagacgggatcaaactaatgtattgcataagtgcaaaaggatctacggaaaatatagcgtatatgaacgacgtaatcaataaacaaaaactctttgaattgaaatcggaaatggaaaaattaggactatgggacaaagtattttcagacttcaaaaacgataacctaaaaaagagtgacttcttcaaaaaacttaatgatcttttaaacaaacattattttgagaacaatgtatgcgacagcattggatcaataaaaaaagtcaaaatcaaagaatcaggcctcacgacaccaaaaggcggtgatgtaattgataattttaaagattttccctatataaagttcaaagtaagtaacttcaatgcactaatcgaaggaatagactttaaaataagcccaacaggaaagtttgtgcagatctga

SEQ ID NO: 9243 - RNA, 4587 nt, synthetic construct
  misc_feature 1..4587: note = Cas9 variant
  source 1..4587: mol_type = other RNA
atgaagaaaattttaggactagacttagggactaattcaataggctgggcacttgtagaacaagatttcaaaaataaacaaggaaatataatgggtatgggatcaagagtcattccaatgtcacaagaaatacttggagaatttgcaagaggaaacacaaaaagcgaaaccgcagaacgaacgcgtcttcggtcagtccgaagacttcgagaaagacaccttctaaggagagaaagactacatcgagtactacacatattaggtttcctaccaaaacactacgtaaaccaaatagacttccaagaaagacttggcaaatttttcgaagaatcagaaccaaaactggcatacgatactggggacttcctatttaaaccatcattcttagaaatgttagaagaatttaaaatccaccaaccttcatttgtagaaggagataagaaagtaccatacgactggacaatttacttcttgaggaagaaagcacttacagaaagaatagaaaaagaagaactagcatgggtaatcctatctttcaatcagaaaagaggatactaccaactgaggggagaagacgaagaagaaaaacctaataaactcgaagaattttacagtctcaaaatagtcgatataaaagtagatgaatcaccaaataagaaaggtgacacatggtactcactaaccttagaaaatggatggatttaccgaagaagtagtaaagtaccactagacgactggctgggcaaaacacgagatttcatcgttacaacggacatagatgaagaaggtaacccaaaactagataaagaaggcaatccaaaacgatcattcagagcgccctcggaagatgactggggtttacgtaaaaagaaaacggaaaaagaaatactagactccagcaaaaccgtaggtcattttatattcgaaaatctacttgcagaccctacacagaaaattaaaggaaggctagtaagaaccattgaaagaaaattttacaaagatgaactgaaacaaatattagtatcacaaaacagattccatccagaactctcagatgctgatatgatggctgactgcgttagggaactatataaacataatcacagccaccaaaactttttagcaagtaaagatataaaacacttattagtagatgatataatattctaccaaagaccactacgaagtcaaaaatcaactataggaaattgtccactggaatttaaaacgttcaagaaagacggtatcgaaataaaagtcccatataaagttgcacctaaatcacatccattatttcaagagttcaggcttctgcaatgggtgagcagtctgagaataataaggaaatcagacgattcagatgtgacgagggagttcctgggtacacaagataaaactaaacaattactggattacctaatgactcaaagcgaaatggattgtaacaaattaatgacatttttactcactcaggaagggtacaaaagaaaagatttaaaaagtgaagtcggaaaattcagatggaattacgtttttgattcagaaacaggagaaagtaaaacatatccaggaaattccactagagcagaatttcttaaaagactgggtaaagtggaaggttttgattttagtaaatatacagaagagttcgaagaatctttatggcatttagtgtattcagtgacagataaagtcgaatttgaaaaagccctaagaaaatttagcaggaaaaatggtattgaaataaattcatttgtcgaaaacctcaagaaatttccaccctacaaatctgaatatgcatcatactctttaaaagctatcaagaaattattagcgctcatgagattcggggaaaattggaaagaagacagcatagatagcatatcaaaacatagaatcgagaaaatactaacaggagaatacgatcctgaaataaaagacaaagtgagagaaatttcacgagcattcgacgaagtagaagatttccaaggcttaccagtttggtttgcaaactacgtagtttatggacgacactcagaagcaagtgaactaataaaatggacttcaagcgatgaaatggctgactttataaaagaatttaaacaacactctctacgcaacccaatagtagaacaggtagttctagaaacacttagagtagtaaaagacatatgggacaaatatggacatggacaaaaagactttttcgatgaaatacacgtagaattaggacgtgaactaaagaatccagcagaacaaagagctcgactgacaacccaaatatcagcaaatgaaaatactaatctaagaataaaatcactcttggtagaactattacacgacccaggagtcgaaaacgtaagaccatactctccaatgcagcaagaaatcttgaaaatttatgaagaaggagtattaaagagttcattcgaagtgcccgacgacatactaaaaataagtaaaactgcacaaccttcatcatcagacctgaaaagatataaactctggctcgaacaaaaatacagaagcccgtataccggtaagattataccactaaataaactttttactccagcatacgaagtagaacatgttatacctcagagtagatatttcgacgatagtttttcaaataaggtcatatgtgaggctgcagtcaacaaattaaaagacaatagattaggaatggagttcataaagtgctttcatggccaacgagtgagtcttggctttggagaagaagtcgaaatatttagtgaatcagcctataaggcgttcatacaagataacttccccaaaaatccagccaagaaaagaaaactccttatggacgaactacctgaacaaatggtagagagacaaatgaatgataccagatacatatcgaagttcgtaacttcaatactgagcaacattgttcgcagcgaagagaatgacaccggatttaacagcaaaaatataatccctgggaatggtaaaataacgacagcactaaagcaagattggggattaaacgatgtatggaatgaattgatcctccccaggttcgaacgaatgaaccaattgacagggactaccgtatttacggcgtggaatgaaaaccatcaaaaattcttacctacagttccgctagaatacgccaagggattccagaagaaacggatagaccatcgacaccatgcaatggatgccttagtgatagcatgtgccacaagagatcacgtaaactatttaaataatgaacatgccttaggcaaaaattacaaaggaaaagaagaaaaacaatcccgaagattcgatcttaggcaaaaattatgcctcaagaagaaaaacggacatagccaagaacaatacgaatggatattctcgaaaccatgggattcattcacccaggatgctaagaaaaatctagaaagaataatagtaagttttaaacaaaacttacgagttattaacaaaaccagtaataaatatctttcctataaagatgaagaaggaaacttaaggttagattcacaaggaaaaccagtcaaagcattgacacgacagatcaaaggggacgcatgggccataagaaaatctatccataaagacactgtaagcggactggtaaaattacgaagagtcaaaatggtgaatctaagtgtcgctttagataatccagaaaacatactcaataagaaactaaagaagaaaatagcagaactcgttaaactaaattacgataataaattattgctaaaatacttccgtgacagagactacatgttcgatggacgtgaagtatccaaacttgacgtttattactttgaagaaggcttagcagcctcccgcgtttcattagacacttcatttagcgataagaaaatccagagtattacagatacaggaataagaaaaatacttcttgcacatttggcaaactaccatggaaggcttgacgaaaaaggtaaggttataccgcccgaaactctggcttttactcccgaaggaatagaagaactaaataagaatattaaaggactaaatggaggaaaattccatcaaccaatatttaaggtccgcacctatgaacctaaaggtaataaatttcaggtaggtttcaaaggaaataagaatagtaaatatgtcgaagctgccaaaggaacaaacctattctttgctatttacctaaacgacgaaggaaaacgatcgtatgaaactataccatttaatgtagtcatggaacgactcaagcaaggggaaggccccgttccacaaacgaatgaaaaaggcggaaaattactttttcacttgtcaccaaatgagctagtgtatgtaccggaaaccgatgaaaattatactaacgttgactttaagaatctctccaaagaacaagttgagaaaatatacaaaatggtatctagtacagggagtgagtgccatttcgtcagagcggacatatctagtctcatcaaaggatatgacgcaaaaacaaaagtcggggaattaggttcgcttaacaaacaagaagtaactaataatggaatgacaagaataaaagagaagtgctggaaaattaaaatcgatagactgggttcgatctga

SEQ ID NO: 9244 - RNA, 4587 nt, synthetic construct
  misc_feature 1..4587: note = Cas9 variant
  source 1..4587: mol_type = other RNA
atgaagaaaatattaggaattgatttgggtaccaatagtatagggtgggcagtcgtcaatagttttgatgaaaaccaaaatgaagaatccttgaaacatatagaatgcgtaggaagcagaatcattccaatggacgctgcaattctaggcgacttcgacaaaggcaatagtatatcccaaacagcaaagcgtacagagtttaggtccgtccgtcatctacgagaacgccacttacttagacgcgcacgactgcacaaaatactatccctattgggatttcttccagaccattatgtccaggatcttgacagtcatggtaattttccagtcaacgtagaaccaaaaatagcctggaggaaagactcaaatggagcattcgaattcatattcaacgatagctttgacgaaatgttacaagactttgcaacctaccaacccgaacttattgcttgcaacaaaaaagtaccctacgattggaccatatattatctaagaaaaaaagctttaacaaagaaactgtcgaaagaagaactatcatggatattgctgaattttaatcaaaaaagaggttactaccagttaagaggagaagaagacgacgaatcggtaaaaagcgcaaaaaccagacaatactttgatagacaaaaaattaaatcaattgtagatacaaaccagacgtataaaggacaaaaagtactaatagtagaactagaagacggaataaagggtaaaatatttaaaaaggaaatcccaaactgggtcggacaagaaaaaagcataatcgttacaatcgacatagacaaagacggctgcgataaatacgaagaatcaggtgaactaagttgtagattcaaaataccctcagatgcagaatgggaatcagaatggaaactcataaaaatgaaaacacaaaaagatcttgacgcgtcaggaaagactgttggggcatacatctacgacgcaatattacagaacccgagccaaaaaataagaggaaagttagttaggacaatagagagaaagtactataaagaagaattgaagcaaattctcaaaaaacaagttgaatttcatccggaactaagggataaagatctctttctcgattgtcttaacgaattatatccaaacaatgacgctcatcgaaacgcatgtgctgatagagactttatctacctattcatggatgacattttattctaccagcgacctttaaaaagcaaaaagtcactcattgcagattgcccctatgaaaagcatatgtatcgagataaggaaactggagaattaaaatacagctcggtcaaatgcatcgcaaaatcgcatccgttatttcaagaatttagattatggcattttatatcaaacatcaggatctatcaaaaagaaagagtagtagatgtagacgctgatcaaagtgccttaagctcagcacgatcagcgctaaaatcaaaactcgaagcggacgtagacgtaaccaatgaatttttgacttgtgaagctgactatgtaagcctctttgagtggttaaacaataaaaaatccgtttctcaaaaagattttctcaagtatccagcattcggaatcaaaaaatcaggagacaattatcgctggaattatgtagaagataaatcttatccatgtaacgaaacaagagccttaatactttcacacttagaaaaagccaacattcgcggtgatatattcacaagggaacaagaagaagccttatggcatatattatacagcgtggaagacagatacgaaatcgtgaaagcattacaatcttttgcagcaaaatacagatttaatgatgattttgtaacggtcttctccaagttcccacctttcaaaaaagaatacggcagctactccgcaaaagctataaaaaaactcttacctctaatgagaatgggcaagtattggtccgaggctgctatcgatataaaaactagggaaagaattgaaaagataatcaccggcgagtgcgacgattctatcagagaaagagtacgattgaaagcaataagactacacgacattggtgatttcagagcgcttccagtatggttagcctgctatgtagtatatgatcgacattcagaaagtggtgacataacaaagtggaaaactcctcaagaaatggactggtacatacaaaacttcaaacaacacagcctcagaaatcctatagtcgaacaagtaatcacagaaactctcagagtggtgagggatatatggaaacaagttggcagaatcgatgaaatccacgtagaactgggtagagaaatgaaaaatccagcagataagcgagctaaaatgacagctagaatgatagaaaacgaaaacacaaacctgagaattaaagcaatgctaactgaatttttaaacccagaatttgaaatcgaaaatgtgagaccttactctgcatcacaacaggatatactacgaatttacgaaaacggagtactaaattcagtaagtgaaatacctgaagaaataaccggtattttaaaaaaatttaacgaaagagaacaaagaaaacgaccatctacaagtgaggtcttgagatataaactttggctagaacaaaaatatagatccccttacacagggaaaatgattccactaggaaaattattcacaccagcgtacgaaatagaacacataatcccacaaagtcgctattttgatgattcattcaacaacaaagttatttgtgaagcagaagttaacaaactaaaaggaaatctactagggtatgaattcataaaaaaacaccacggacgcagagtagacttaggactaggagagattgtagatattttcagcgtagatgaatacgagacattcgtaaaagactactatagtgccaaccaacaaaagatgaaaaaattacttatggacgaaatccctgaacaatttatcgaaagacaactgaacgactctcgctatatctcaaaggttgttaaatcattactgtccaacattgttagagaacaagatgagcaagaaagcataagcaaaaatctaatagtctgtaccggtggcgtaacagatcgactaaaaaaggactggggaatcaacgatgtctggaacaaactaatattaccaaggttccaaagactgaataacatcactgagacaacagaatttacggcgaaaaacatgcaaggacacgaaatacccgttgtccctttcgaataccaaagaggatttaataaaaagagaattgatcaccgtcatcacgccatggacgcgatagttatagcctgtgcaggcagaaatatagtaaactatctcaataatgaatcagcacgaaaaaaagcccaaattagtaggtatgacctccaaagactactatgtgataaagtcaaaactgacgataacggaaattacaaatggatactaaaaaaaccgtggtctactctaacacaagatgtttacgcggccctagataacgtgatagtctctttcaaacaaaatctaagagtcataaacaagaccaataaccactatgtgcattatgaagcaggaaaaaaaataatagcaaaacaagaaaaagcatcatgggcaataagaaaaccaatgcacaaagacaccgtattcggtgaagttaacctaagaaaggtcaaaactgttagccttaacgaagcgataaaatcgccccattgtatcgtacagaaagatttcaaaaagaaattactaagtttattaaaacaaaacttcgatgcaaaggaagtaaaagcttattttgaagaacacaaggacgtttggagcgatattaacctaagcaagatcgaagtctattattttaccaaagacactaaagaaagattctttgccactagaaaacctctggacagttcttttgatcgtaaaaaaatagaaagcgtaactgacacgggaatacagaaaattctactaaggcacttagaacaaaaaaatggagactcagatctagcgttctcaccagatggtatagaagaaatgaatcaaaacattgtacaattaaacggtggtcgaaaacatcaacccatagttaaggtgagagtgtatgaaaaagccgataaattcgcaataggacaacaaggcaataaagccagtaaatacgtagaagctgctaaaggtaccaacttattcttcgcagtgtatgaagaagaagttagggacaaaaagaccaacgctgtaatgttcaagagaaattatgccagtattcctttaaacgtagcaatagacaggcagaaaaaaggcttaagtacagcgcccgaagacgaaaatggaaacgctccaatattcgttctgtcaccgaatgatctagtatatttgcctacagccgaagatataataaatgcaagaatcagtttcccaataaacaaaaatagaatctacaaaatggtttcatgtacaggatatcaatgcttcttcataaaacatcacgtagcaaacgtcatagtggacaaaaaagaattctccgccttaaataaaatggaaaaggcagagactaacgaaatgataaaagacatatgtgtacccattaaattagatagactaggaaacatagtcaaaattggagtttacaaatga

SEQ ID NO: 9245 - RNA, 4587 nt, synthetic construct
  misc_feature 1..4587: note = Cas9 variant
  source 1..4587: mol_type = other RNA
atgaaaaaaatcctcggactagacttaggaactaattcaataggatgggccgtcgtgaactcattcgatgaaaaccaaaatgaagaatcgttaaaacacatagaatgcgtaggaagcagaataatacccatggacgctgcaatactaggcgacttcgataaaggaaacagtataagtcaaactgctaagaggactgaatttagatcagtccgtcatctaagagaaaggcacctgttacgaagggcaagattacacaaaattttgtcactattaggtttcttacctgaccattacgttcaagatcttgactctcatgggaattttcctgttaacgttgaacccaaaatagcgtggcgtaaagattcaaatggagcattcgagtttatatttaacgacagctttgacgagatgctacaagattttgcaacctatcaacccgaattaatagcatgcaacaaaaaagtaccttatgattggacaatctactacctacgtaaaaaagcgctcacaaaaaaactttcaaaagaagaactaagctggatcttattaaatttcaatcaaaaaagaggatactaccaattaagaggagaagaggatgacgaatctgttaagtcagcaaaaacacgacagtactttgacagacagaagatcaagagtatagtcgataccaatcaaacgtacaaaggccaaaaagtattaatagtagaactagaagacggaataaaaggaaaaatcttcaaaaaagaaatcccaaactgggtaggacaagaaaaaagcatcatagttacaatagacatcgacaaagatggttgcgataaatacgaagaaagcggagaattaagttgtagatttaaaattccctctgatgcagaatgggaatctgaatggaaattaataaaaatgaagactcaaaaggatttggatgcatcaggcaagacagtaggagcatacatttacgacgctatactgcaaaatcccagccagaaaataagaggaaaattggttaggacaatagaaagaaaatattacaaagaagaactaaaacaaatactaaaaaaacaagttgaattccatcctgaattacgagacaaggatctctttctagattgcctcaatgaactatatccaaacaacgacgcacaccgtaacgcatgcgcagaccgtgatttcatatacttattcatggacgatatcctattctaccaacgccctcttaaatctaaaaaatctcttatagcagattgtccgtacgaaaaacatatgtatcgagataaagaaaccggagaactaaaatacagctcagtaaaatgtatcgcgaaaagtcacccactgtttcaagaattccgtttatggcattttatatcgaacataagaatctatcaaaaagaaagagtagtagatgtagacgcatgtcaacctgatctctcatctgcgcgatcggctctgaaatcaaaactagaagcagatgtagacgttacaaatgaatttctaacatgtgaggcagattacgtatcattatttgaatggctcaataacaaaaaatctgtttctcagaaagactttctcaagtatcctgccttcggcataaaaaaatccggcgacaactatcgatggaattatgtggaagacaagagttatccatgcaatgaaaccagggcattaatactaagtcatctcgaaaaggcgaacataagaggagacatatttaccagagaacaggaagaagcactatggcacatcctatattccgtagaagacaggtatgaaatagttaaggctttgcaaagttttgcggcaaaatatagatttaatgacgactttgtaacggtattttcaaaatttccgccattcaaaaaggaatacggatcatatagcgcaaaagcaattaagaaattgttaccattaatgcgaatgggaaaatactggtcagaggctgcaattgatataaaaacccgagaaaggatagaaaaaatcattaccggagaatgcgacgacagtattcgcgaacgcgtaagattaaaagcaattcgactgcatgatataggagactttcgagccttaccggtctggctagcttgttacgtagtatatgataggcattcagaatcaggagacataacaaaatggaaaaccccccaagaaatggactggtatatacaaaattttaaacaacactcacttcgaaatcctatagttgagcaagtaataacagagacactgagagtagtaagggacatttggaaacaagtaggtagaatagacgaaatacatgtagaactgggaagagagatgaagaaccctgcagataaaagagccaaaatgacggctcgcatgattgaaaatgaaaatacaaaccttagaataaaggcgatgctcaccgaattcttaaatcccgaatttaagattgaaaatgtaagaccatactcagcatctcaacaagacatactacgaatatatgaaaatggtgtattgaacagtgtctcggaaatccccgaagaaattacaggaatcttaaaaaaattcaacgaaagagaacagcgtaaaaggccaagtacttcagaagtactaagatataaattatggttggaacaaaaatacagatcgccatacacaggcaaaatgatacccctggggaaactatttacacccgcatatgaaatcgaacatataatcccgcaaagtagatacttcgacgattcgttcaataataaagttatatgcgaagctgaagtaaacaaattaaaaggaaatctcttagggtacgagttcattaaaaaacaccatggacgaagagttgatttaggtctcggtgagatagtagatatattcagtgttgacgagtatgaaacattcgttaaagattattatagcgcaaaccaacaaaaaatgaaaaaactgctaatggacgaaatcccggaacaatttatagagagacaacttaacgactcaagatacatctcaaaagtggtcaaatcacttctttccaacatcgttcgagagcaagacgaacaggaatcaatatccaaaaatttaattgtatgtacaggaggcgtaacagacagattaaaaaaagactggggtataaacgatgtctggaataagttgatactaccgcgctttcaaagattaaataatataaccgaaacaactgaattcactgcaaaaaatatgcagggccacgaaatccccgtagtaccattcgaatatcaacgaggattcaataaaaaaagaatcgaccacaggcatcacgcaatggatgccatagtcattgcttgcgccggacgcaatatcgtaaactacctaaacaacgagtccgcaagaaaaaaagcacagatttcaagatacgatctacaaagactgttgtgtgacaaagtaaagaccgacgacaacggtaattacaaatggatacttaaaaaaccctggtccactctcacacaagacgtatatgcagcactagataatgttatcgtcagcttcaaacaaaatcttagagtcattaacaagacgaataatcattacgtacactatgaagcaggaaaaaaaataatcgcaaaacaagaaaaagcttcttgggcgataagaaagcctatgcacaaagataccgtgtttggagaagtaaatttaagaaaagtaaagacagttagcctcaacgaagcaataaagtctcctcactgcatagtccaaaaagatttcaagaaaaaattactatcactattaaaacaaaacttcgacgccaaagaagtaaaagcatactttgaagaacataaagacgtatggtcggacataaatttaagtaaaatagaagtatattattttaccaaagatacgaaagaaagattttttgcaacaagaaaacctttagattcatcattcgacaggaaaaaaattgaaagtgttactgataccgggattcagaaaatattacttagacacttggaacaaaaaaacggagatagtgacctagcattttctccagatggaatagaagaaatgaatcaaaacattgtacagctaaacggtggacgcaaacaccagcctatcgtgaaagtaagagtctacgaaaaagcggacaaatttgcaataggacaacaaggtaacaaagcctctaaatacgtagaagcagcaaaaggaaccaacctattctttgcagtatacgaagaagaagtacgtgataaaaagactaacgcagttatgttcaagcgcaattatgcctccatacctctaaatgtagcaatagatcgccaaaaaaaaggcttgtcaactgcacctgaagacgaaaacgggaacgcaccgatatttgtattgagtcccaatgatctagtttatctcccaactgctgaagatatcattaacgcccgaatttcattcccgataaacaaaaaccgtatttataaaatggtttcatgcacaggataccagtgttttttcataaaacaccacgtcgctaatgtcattgtagataaaaaagagttcagcgcattaaacaaaatggaaaaagcagagacaaacgaaatgataaaagacatctgtgtaccaataaaactcgatcgcttaggaaatatagtcaagataggtgtttacaaatga

SEQ ID NO: 9246 - RNA, 4590 nt, synthetic construct
  misc_feature 1..4590: note = Cas9 variant
  source 1..4590: mol_type = other RNA
atgaaaaaaattttaggcttagacttaggaacaaactcaatcggatgggcagtagtaaactcattcgatgaaaatcaaaatgaagaaagcctaaaacacattgaatgtcttggttccagaataatccccatggatgcagcgattctgggagactttgacaaaggaaattcaatatctcaaacagcaaaaagaaccgaatttaggggtgttaggcatttaagagaaagacatctactaagacgtgcacgtctccataaaatactaagactattaggattcctaccagaccattacgtacaagatctagacggacacggaaatttcttagtaaatgtcgaaccaaagattgcttggcgaaaagattctaacggcacatttgaattcatctttaatgactcctttgacgaaatgttacaagactttgcaacctaccaacctgaattaatagcatgcaatcgcaaagtgccctacgattggactatatattatctacgaaaaaaagcactgacaaaaaaactaagcaaagaggaactatcatggatactattaaatttcaatcaaaaaagaggatattatcaactgcgcggagaagaagatgatgaaagcgtaaaaacagcaaaaacaagacaatactttgatagacaaaaaatcaaatctatcgtcgatactaatcaaacttataaaggccaaaaagtactaatcgttgagttagaagatggagttaaaggaaagatattcaagaaagagatacccaattgggttgggcaagagaagtcaatcatcgttaccgtagacatcgataaagatggatgtgataaatacgaagaaagcggagagttaagctgtaggttcaaaataccaagtgatgcagaatgggaatccgaatggaaattaataaaaatgaaaacacagaaagatctagacgcttcaggaaaaacagtaggcgcttatatatatgacgcaatactgcaaaatccaagtcaaaaaatcagagggaaactggtcagaacaatcgaaagaaaatattacaaagaggaattaaaacaaatactaaaaaaacaagtagaattccatcccgaattaagagacaaagacctctttttagactgtctaaacgaattatatccaaacaacgacgcacatagaaatgcctgtgctgatagagattttatatatttgtttatggatgatatactattttatcagaggcccctaaaaagtaaaaagtcactcattgctgattgcccctatgaaaaacacatgtatagagataaagaaacaggagagctaaaatattcgtctgtgaagtgcatcgcaaagtctcatcctttgttccaagaattccgattatggcatttcatatcaaatataagaatttatcaaaaagaaagagtaattgatgttgatgcatgccaacctgacctaagcagtgctagaagcgcactaaaatcaaagttagaagcagatgtagacgtaacaaatgaatttctcacttgtgaagcagactacgtgagtttattcgaatggcttaataataaaaaatcagtctcacaaaaagactttctcaaatatcccgctttcggcatcaaaaaaagtggagataattaccgatggaactatgtagaagacaaatcatatccttgcaacgaaactcgagcgttaatcttaagccacttagagaaagctaacataagaggagacatatttacaagggaacaagaagaagctttatggcatatcttatattcggtagaagaccgatatgaaatagtgaaagcactacaatcatttgcagccaaataccgatttaacgacgatttcgtaacggtatttagcaaattcccaccattcaaaaaagaatatggttcgtacagcgctaaagctattaaaaaactattaccactaatgagaatgggaaagtactggtccgaaagtgcaattgacatcaaaacaagagagaggatcgaaaaaataattaccggggaatgcgatgattcaatacgagaaagagtgcgactcaaagcaatacgactccacgatatcgaacactttagagcgctacccgtatggttagcatgctatgtagtttatgacaggcacagtgagtcaggagacattatgaagtggaaaaccccccaagaaatggatagctacatccaaaatttcaaacaacactcattacgcaacccaatcgtagaacaagttataacagaaacattacgggtcgtcagagatatatggaagcaagtaggacgaatagatgaaatacacgtggaactaggacgcgaaatgaaaaacccagcggataaaagaaaggaaatgacaaaaagaatcatcgaaaatgaaaacaccaatcttagaattaaggccatgctaacagaatttttaaacccagaattcgaaatagagaacgtaagaccttactctgcttcacaacaagatattcttagaatctatgagaacggagtactaaactctgtaagtgaaatcccagaagaaatcactgggatattaaaaaaatttaatgagcgtgaacaacggaaacggccatcaacaagtgaagtgctgcgttacaagttatggctcgaacaaaaatattgtagtccatatactggaaagatgataccactaggaaaactatttacgcctgcctatgaaatagagcacgttatcccacagtcgagatacttcgacgactcgtttaataacaaagtaatatgtgaagccgaagttaataaattaaaaggaaatcttcttggttacgaattcataaagaaacaccatggccagcgagtcgatctcggtctcggggaaatagtagacatattctcggtagacgaatatgaaactttcgtaaaagattattattccggaaaccagcaaaaaatgaaaaaattactaatggacgaaataccagaacaatttatcgaacgacaactgaacgatagtagatatatatcaaaagttgtcaaatcattactaagtaacatagtacgcgaacaagacgagcaagagagtataagtaaaaacgttattgtatgtacaggtggagtaacagatcgactaaaaaaagactggggtatcaacgacgtttggaacaagcttattctgccgagattccaacgcctcaataatatcacagaaacaactgaattcacagccaaaaacatggaaggccacgaaattccagtagtgcccttcgaatatcagaggggtttcaacaaaaaaagaatagaccataggcaccacgcaatggatgcaattgtaatagcttgtgcgtcaaggaacatagtgaattacctaaataacgaatcagctagaaaaaaagcaagaatatctagatatgacttacaaaaactactatgtgataaagttcgtacagacgacaatggaaattataaatggatactaaaaaaaccatggggtacgttgacccaagatgtatatgctgctctggataacgtaattgttagctttaagcagaatttgagagtaataaacaaaaccaaaaactattacgtccactacgaagcaggaaaaaaaacaattgcaaaacaagaaaaaggcagctcttgggcgatcagaaagcccatgcacaaagacacagtattcggagaagttaatttgcgaaaagtaaaaaccgtaagcctcaatgaagcaattaaaaacccccaatgtatcgtcgaaaaagatttcaagaaaaaactcctatcactccttaaacaaaactttgacgcaaaaaaagtaaaggcatatttcgaagaacataaagacgtatggtctgacataaatcttagcaaaatagaggtctactatttcaccaaagatacaaaagaaagatttttcgctacgagaaaaccactcgattcaagtttcgacaagaaagaaatagaatccgttacggataccgggattcaaaaaatcttactcagacacctagaacaaaaaaacggagatccagacttagcattctctcctgacggtatcgaagaaatgaaccataatatagtgcagttaaacggcggcagaaaacatcaaccaattgtaaaagtaagagtatacgaaaaagcggataaattcgcaataggccagcaaggaaacaaatcatcgaagtacgttgaagccgcaaaaggcacaaacctgttcttcgccgtatatgaagaagaagttagagataaaaaaacaaatgcagtaatgctaaagcgtcactacgcatcaatccccctaaatgtagcaatcgatcgacaaaaaaaaggactcagtaccgcaccggaagatgaaaatggaaatgtaccgattttcgtactatctcccaacgacttggtctaccttccaacagctgaagacatcgctaacgcatcaattagctttccaataaataaaaatcgcatctataaaatggtatcatgtactggtaacaggtgtttcttcataaaacatcatgtagcaaacgttatagtagataaaagtgaattctctgtattaaacaaaatcgaaaaagctgagacagacgaaatgataaaggaaatatgtgtgcccataaagatagatcgattaggtaacattgtgaaaataggtgtatataagtga

SEQ ID NO: 9247 - RNA, 4608 nt, synthetic construct
  misc_feature 1..4608: note = Cas9 variant
  source 1..4608: mol_type = other RNA
atgaacacgatactaggactagatctaggtactaactcgataggctgggccctaatcaaagtactaaacgataaaacccgacttccactagaaatcatagatttgggcgtagtagtaatccccaccgatcaacgaacactagacaaattctccaaaggtgaaagcattagtaaaacagcagaaagaacgaaacaaaaaggcgttagaaaactatacgaaaggaagaaattaagaagagaaagattacaccgtgtactcaacattctaggctttctaccagaacactactcgaagaaaattgactttaagaaacatctaggacaattctttggcaactcacaaccaaaaataagctatgtagaaaacgatcacggaaaacatgagttcatattcatggattcctatagagaaatgttaaaagaatttagcaaacacaacattaaaaacgtcccatatgattggacaatatattacttaaggaaaaaggctttatcccagaaaatatcaaaagaagaattagcctgggtcatactaaattttaacaagaaaagaggttactatcaatttagggatgacaacgcagatgaaaacaaagaaaataaaatagaaaaatattatgcacttaaagtaactaatgtcaagaaagaagatgcacaaaattataccataacactggaaaatggatggatctataaaaacaaaagtaaaattagcttactagattgggtcggttcaacaaaagagttcatctcaacggaaaaattcgacaacaaaggtaatataatcaaaaagaaaaacggagaagatgatagaacactaaaattagtggatagcgaaaaagactggatagcaattaaaaagtccaccgaagacagaatagaaaattatggcaaaaccgtaggaacatacctatacgaacacctactaaaagacccaaaccaaaaacttaatggtgaactaattaatataattgacagaaaattctacaaaaacgaacttaaacaaatattggaaaaacaaaaagaatttcaccccgaactcctcaacgaagacttattccagaaatcaataatagaactatatcccaaaaactccacgaggcagaaagaactcaaaaataaagacctctgctacttgcttattgacgacgtcatctattaccaaagagacctcaaaaagaaaaattcgactataaataaatgcagcttcgaatctcgcgaatattacctcaatggagaaaaacagatacagaaaataaactgcattgcaaaaagcaagccactataccaagaatttcgtaccctccaattcatcaaaaatttaaaagtgtacgaaataattgacggcctagaaaaagacataacaagtaaactcctcccggacttcgaaaccaaagaacacttcttcgaatggttgaatgacaaagagaaaatagatcaactacaactccttagctataagtgtttcgacctacatgacaatgtaaagaatgatctaatcgcaaaaggaataaagcgacctaccgaaaaagcaatacgcacagaactactagaaaaatacagatggaactacagcaaagacaacgacagaaatttcctactaaacgaaacgagattcaaaattttaaaatacctaaagaaagtagataagaaattgactttaacgaacgaacaaatagaatccctatggctcttactatattccgccaaagacgaacgtgaattgaaaaacggacttcaaaaattctcagagaaaaacaaactccctaagaaattctccgatattttcatatcattcccaccattcaagaaagaatacggagcatacagcgaaaaagcactaaagaaactgttatccctagttcgtttcggaaaatactggagctttaacaaaattgataacaatatccaaaataaaataatgaacatactaaacggcgaagtagacgactcgatatcagaccgagtaagagagaaaacaatactattacaggacaaaaatgacttccaagatctacctttatggttagcatcttacgtagcatacaaccgcttcagcgaggtcagcgaaatcaaatactgggatagccctgataaaatagagttcctcaaacaacactcaatcggtaacccaatagttgagaaaataataaacgaaacccttaaactaatcaaagacatttgggttatacatggcaaatcctgcaaaaacttcttttccgaaatccacattgaactgagcagagaaataaaatctagtagcaagaaacgagctcagatcaccaacaataataccaaaaaccaaaaactcaacaatcttatcaaatccctgcttatagaaatggcatctgatacaaagtatgaaaatgtaacaccatactccccatcacaacaagaaatactaaaaatctatgacgaaggaatatattcaaaagaagagaactcagagaaaataaaagaaataaataaaataagaaacaacaataaaatctcaaaatcagacataactaaatacaaactttggcttgaacaaggctatatttccccttacactgggaagataataccactaaccaaactattcacagccaaataccaaaaagaacatataatacctcaaacaaaattctttgacgacagcttcaacaataaagttatatgtgaagccgaagtaaataaactaaaagataattccctcgccatgaactttatcaaagccaaaggcggaaaagctgtaaaactatccgacggcgaaactgtaacaatcctaaaccaggaagaatacaaacaattagtaagaacctcatttaagaaaaattcaatcaaactacgaaatctacttttagaagaaataccagatacattcacgaaaagacaacttaacgacacaaaatatatatcgaaactcgtactttcgctattatcgaacatagtaagagaaaaaggtgaactcgaatcaacagctaaacgaatcgtgtcaactaacggccaaatcacaagcatcctcagaaacgattggggcctaaacaacatatggaataaactcataactccacgattcgaaagacttaataatataaacaaaaacaaaatatatggtaattgggaaaacaagaaaggtaaaaacgtatttcaaataaactacctcaatgacaatttaagcacactaaatactaaacgcatagatcatagacaccacgcacttgatgctctaatcgtcgcctgtactacacgaaatcacataaatttcctaaacaatcaatatgcaaaatcccgtaatcaacgacatgacttaagagcaaaactaaaaagaagagaaacaataacaacagaaggtagcaagaaacaagtctttaaagatttcataaaaccttgggaatccttcactcaggatgcacttaagaaacttgaaacgacgatagtaaactttaaagtaaacaaacgaatcataaacaaaacaataaactggtacaagaaatgggaaaaacaaaaagacggaacttataagaaaatacagaagaaacaaaccaaaggagatgcatgggcgatcagaaaaccattacacatagataccatatacggaatcgtctgcaagaaactccccctcaaatcagcactagagaattataaaaacataatcgacgaaaaccttaaacacaaaataaaagaactaaaagaagtcaacaaatttgataacaaccaaatcatcaatttctttaaagagtgtaacttcatcttcgaagataacaacattcaaaaagtagaagtatacgacttcaaagataacagagataaaacaatactctcatcaagccgacaactcatagatgaatcatttacacctaagaaaataggcaaagtcctagacccaacaatcaggaacatattactgaaacacctaaactctacaaaatataacaataaattcgattcggatggcaaccccataaaacccgaaaaattagccttttctccagaagggctaaaagacctcaacaaaaatataaagcacttaaataataataaggaacatcaaccaattaagagagtcaaacttttcgaaaccctcggcaacaaaattaaagtagggtacacacaacagaaaaataaaaagtttgccgaaacggctacaggaactaacttattcctcggaatttattccgacaataacaaacgagatttcaaaaccatacccctaattctcgcaatccaaagagaaaaagaaggactaaacccatgtcccgatactgacgaaaagggaaaccaactgttattttcactttcgcccaacgaattggtctttgttcctaataacgaagaacgcaaaaaccctaacctagtagactttgaaaatctctcaaaagaccaaatagacagaatatataaattcgtatcttgtaccggaagtgaggcttatttcgtgccatcaagaactgcaaaaccaataatagaaaacgaaaacggcaccaacaacaaatcacaacgaataatcgagttcaatgagaaaacctcaataaagaacgagaagaacgaacccgtactaatcaaaacgatctgctggaaaatagaagtaaacagactgggtaaaataataaaagtaatcaaatga

SEQ ID NO: 9248 - RNA, 4608 nt, synthetic construct
  misc_feature 1..4608: note = Cas9 variant
  source 1..4608: mol_type = other RNA
atgacaaaaatattaggattggatcttggtactaattcaataggatgggcgataagagatacagaaaatgaaggcataaatcaaatcttggacaaaggagcccggatctttagtgaaggagttaaatcagagaatggtaaagaaatatcaagagctgccgaaagaaccgcttatagatcagcacgaaaaataaaatacagaagaaaactcagaaaatacgaaacattgaaagtactaagtatcaatggtatgtgcccactatctgtcgaagaggtcgaacaatggaaaaagtccggattcaaagaatatcctctcaacccagagtttctagactggctcaggaccaatgaagacaaaaacattaatccttatctattcagagataaagccagtaaacaaaaagtcacattatttgaactcggacgagcactatatcacatagcacaacgaagagggttcctatctaacagactagaccaaagcgcagaaggagtttttgaagaacacaacccgcaaatccagaatttaatagaagacctcgactcaagtaacacgatactcaacgagctgaaagaatattacatcaacctaggtataattgatgaaaccgaaaaatcaggattcaaaaaagacttagatgaaggtgaaaaaaagttaaaatcactgtacaattcacttgtcgcgataacaaagaagaacgcaaatgacatagagacttgtaagcaggaattaatagcaagattgaataaaaaggaagacctaggtaaggtgaaaggaaaaataaaagacatatcacaagcaatgttggatagaaatttcaagacattaggacaatatttcttctccctctacaataaagaaagaattcgaaaccaatacacctcccgagaagaacactatttagaagaattcataatcatatgtcagacacaaggcatagaaggaatcaacaccaacgaaaaactcccagaaaagaaattcacgggtcttgcaaaagacctatatagggctatcttcttccaacgcccgctaaaatcacaaaaaggtttgataggaaaatgttcgtttgaaaagaataagtcaagatgcgcagtatcacacccggattacgaagaattcaggatgtggtcttacctaaatacaataaaaataggaacccaatcagaaaaaacactcagatttttaacacttgaggaaaagctgaaattggtacctaagttttaccgaaaatcagactttaattttgaagttttagctaaagaattggtcgaaaaaggagcttccttcgggtactacaaaagctctaaaaaaaacgagtttttctactggtttaattacaaaccaacagattccgtaagtgcatgcgtagtatcagcgtcgcttgaaaatgctataggtaaggactggaaaataaaaacattcgaataccaaactcgtaatactgaaaaaaatgaagtcacaaaaagtgtagattataaggatctttggcacctcctaagtgtagctacttcagatacttacttatatgatttcgcaatcgagaaattaaaattagaacctaaaaacgcaaaagcatttagtaaaactaagctaaaaaaagacttcgcaagcttatcccttgctgctatagccaaaattctaccttacctaaaacaaggattactatattcacacgccgtattcatggcaaatattgagaacatagtagacgcggacatatggaaagatgaggaacaacaaaaattcatacaatcaaagatagtagaactagtagataactatatagtcgaaaaaagcaaattagaactcatcaacggactattaaaaatttacaatacagaagataaagaaggaagaaaagtatattacagcaaagaagctgagtcactattcgaagctgacttaagaaaaaagctcgtcccattttacaaagccaatataataattgaagaacacgaacaggaaataatatttcaagacctattcccaatactaatggatcaattaaagaagcaagagttcataaaaattggtaggcttgacaaacaaattgaagcatttttggagggtgaaaacgaggagggtcaaatcttttgcaaccacactgataaattgaaaaaactttaccaccctagcgacatagaagtcttcaaaaaaaaaacaataaaggacgaatggggaaatgaaaaggtagtcttaggctcaccgctaactacatcaataaaaaatccaatggccatgagagcattacatcaacttcgtaaagtactaaacaccttaattgccaacgaccagatcgacgaagatacaaggatacacattgagatggcacgagaactaaatgacgcaaacaaaagaaaaggtatacaggacttccagaacgagaacaaaaaattcagagaagaagccataaaagaaataaaaaaactctatttagaagaatgccataaagacgtgaacccaacagaggacgacatactaagataccaactatggctcgaacaagggaaatgcgaaatatacgaagaaggaaacaacatctcaatatgtgatattattggcagtaacccatcctacgatatagagcacacgatcccgcgaagtatttcacaagacaactcccagatgaacaaaaccctttgtagccttaaatttaatagatcaatcaaaaaacaaaaaatgccagtagagctctcaaattataatgacatactaccacgaatcgcacattggaaaaaagaagcagaagaattaacacgccaaatagaaactataagtaggtctattaaatcggcagcaacaaaagtagcaaaagataaaaacatcagaaaacgacactatttaacattaaaacgagattatatccttggaaaatatgagaggttcacctgggaagaacccaaagtcggttttaaaaattcccaaatccctgacaccggaattatcacaaaatatgcccaagcatacttaaaaagctacttcaaaagagttgaatcagtcaaaggaggcgcagtagccgaatttcgcaaactttggggaatccaagaatcttttattgatgaaaactggtggaagcactataaagacaaggatcgtgataaacacacccatcacactatagacgcaataactatagcctgtatgcctaaagataaatacgatctactagcacatgcatggagattagaagacgaacaagacaaaaaagcggctaaagtcctaatcgaacaggcaaaaccctggaagacatttaaagaagatatagagaaaatcgagacagaaatacttgtatctcactttacaccagacaacgtcaaaaaacaaagcaaatccataataaaaaatcgcggaaaaaaagtatatgtacttaaaaacgaactcccagttaattttaagaataaaatagaaggaaaagattacttcaaactaaaatttgattcaaaaatcctatacaaaatcccaaaaaaaaaggaaaaacaaacagacactttctacgaggaacttccgaaaaattatttgaatggagttgaaggaaaagattactttaaaatcaataccaccggcaaaaccttttacaaaatacctatattcaatcaaggagatactataagaggttcactccatcaagaaacgacatacggagctataaagttacccgatatcgacatagaaactaaaaagccattacacacggacaaaggtggctttatcctcaaaaaagatataaaagggaacgaaatcgtttttttcgtcgtacgaaaagaaataagcaaaatctcagaaaacgacgttcaaaacattgtcgataacgtagtgagaaaaaaaatagaaaatgcaatagcaaactcgctaattacattcaaaattgtaaagaaaaaaaaagtagcagtaattaaagaaggcgtaacaatctggatgagagagccaaatatcgaaaaaggaatagaaggtataccaataaaaaaagtcagaatcataacaaacagtgtgaaaaatcctatcgaaataaaagtacatagtccattatcaaaatcacgtcataagcataagcaaaaagtatatggacaaaacgacgaaaattatgcgatggctctatacgaactcgacggaaaaagggaattcgaattaataaacaattttaatctagctaaactcctgaagcaatcccaatcctactaccctcttcacaaggaaaaagaaattaaaggaaaaaaaatactcgtacctatagaaaaacgcaacaataaagatgtaatactaaaaagaggacaacaagtagtattctacgataaaaccgttgaaaatccaaaggatatcagtgaaatcatagatttccgagaacgaatatatattattgaaggcctaacaatacaacggcaaaaagacaaaaaaacttccaaagttaacgaatacggaattatacaactaagacacttcaaagaagcaagaaaatcagaagaaatctctaaagacaattttaaacctgatggagaatttaagataaatgaaaacaaaccaacaagaaaaatgaaccacaaccagttcactgcctttgtggaaggaatagatttcaaagtactaccttccggaaaattccaaaagatatga

SEQ ID NO: 9249 - RNA, 4614 nt, synthetic construct
  misc_feature 1..4614: note = Cas9 variant
  source 1..4614: mol_type = other RNA
atgaagaaaatcctcggcctcgatctgggcaccaactccataggttgggcattaacaactaacgatttcgatactaagaaaggaacaattgaaggtttaggatccagaatcatacccatgagtcaagacatactcggaaaattcgattcaggggtttcattatcacaaacagcacaacgtacagaataccggggcaaacgacgcctagtacaacgattccttttaagaagggaacgtcttcatagggtactacacatcttagaactcttaccaaaacaatatagtgaagctatcgattttgataagaaattaggacaattcaaaccagaacgtgaacagaaaattagcttttacaaaaatgaaagcggcaaaaatcaattcatattcacgaaatcacaccaagaaatgctaacagagttccaaacatattatccaacgatcaaaaatattccatatgactggactatctactacctaaggaagaaagcgctaacagagaaaatcagtaaagaagaactagcctggattctattaaacttcaaccagaaaagaggctactatcaactaagaggagaagaaaaagaagaaaataaaaataagaaagaagagttccacacactattggtgacagacatcatcgaacgcgataaaggcaaatcaggcacatggtataacgtaatactagaaaacggatggatatacaaaagagaatcaaaaattagcctcgcagattggataggcaaaacaaaatcattcatagtaaccacagaatataatgatgacggaagcgttaaattaacaaaagacaatgaagaaaaacgtagcttccgatccccaaaagaagatgactggggattgattaaaataagaactgagaaaacaataaatcaatcagataaatctgtaggagcatatatttatgacgcattactcaaaaacccaaatcagaaaataaaaggagaattagtgagaaccatagaaaggaaatattataaagacgaacttagagaaatactaaagaaacaattagaatttcattcagatgtactcaacgataaaatactctacaagaaatgtatcgacgaactatacaaaaataacgattcgcataaaaacagtatcaaagatcgtggcttcgattatctattcctagacgacataatattctaccaaagaccactaaaatcaaaaacgagtttaattagcgattgcagtctcgagttccgccctatcaaaaacaaaaacggggtattagtcaaagacacagacggaaaacaaatagccaaagccctaaaatgtatagcacgaagcaatccaatattccaagaatttagattactacaattcgttaaaaatctgaaaatatacaaaaggggcgtcgtagatgacgtagaagtaaccaacgactatcttaaaagtgaaaacgatgtggaaaaactattcaactggctaaacgataaagcagaaatcaaccaaaaacaatttctagtaaactttaaactgaaagaagacaaacatagatggaacttcgtagaagacaaaggctatccctgtaacgaaacacggaatcaattccttaatgcaattgcaaaaattgatgtagacaaatcattctttaataccaaaaatactcaagacctatggcacatactctacagcgtgacagataaaatagaaataacgaaagcaataacaacctttgcaaaaaggcataatctacccaatgaatttatcataaacttcagtaaaataaaaccatataagaaagaatatggttcattctcagaaaaagcaatcaagaaactactacctttaatgaggttcggttcgtactgggatgccaaaaacatagatataaaaactctggaccgcatagacaaaatccaaacaggagaatttgacgagaaaattagaaacagagttagagaaaaagcaatagacctacataaaatcgacgatttcaaagatttacctttatggttagcatcatacatagtttatgacaaacatagtgaggcttcagatgtaagcaaatggaaaactcccgccgacatagaaaaattcttgaaacatgagttcaaacaacatagtctgaggaaccctatcgtcgaacaagttattacagaaactctacgtgtcgttaaagatatttggctccaatacggagaaggaaaagaaaatttcttcaatgaaattcatatagaactaggaagagaaatgaaaaatgacaaagcgacacgcgagaaaatatcaaagaaagtgtccgaaaatgaaaacacaaatctcagaattaaagcgatacttacagaactcaaaaacgacggagtctcagatatcagaccctactcaccgtcacaacaggaaatactaaaaatttacgaagaaggggtgtataacaacgaatcaagaaaagaaaaactcgaagaagttgataaaataaggaaaaatgctaaacccaccacctcagaaataataaaatacaaactttggttagaacaagggtacgccagcccatatactggaaaactaattcccatgtctgaattatttacaactaaatatcagatagaacacattataccgcaatcccgattctttgatgacagcttatctaacaaagtaatctgcgaatcagaagtaaacgagcttaaatcaaacatgacagcattagagttcattctgacgaatgaaaatcgaatagttacattaacaggaggagaaactgtgaaaatattcaccaaagaggcttacaatcaacatattatatcatattattcaaagaataaaaacaaacaaaaacggttattaaccgaagaaatacccgaacaatttatatctaggcaattaaacgacacaaaatatatatcaaagatcgtcaaaaacttactttcgaaaatagtaagagaggaagacgaacaagaagttacgagcaaacacgttgtatcgctaaacggatccataacatctagaatgaaacaagattgggggctgaacgatgtttggaacacaatcgtcagcccacgcttcgaaagactaaacacgttaacaaatagcaatgacttcgggcaatttgaacttaagaaagacgcttacggaaatgaaggcaaacgtgtctttcaaaccacagtaccagatgccattgcaaaaggatttacgaagaaaagaatagatcatagacaccatgcgcttgatgctctagtaatagcatgcgtaaacagaacgcacataaactacttaaacaatctaaatgccaaagatactgatgacaaagccgttaaacatgaactccgaaacaaactatgtttcaaaaccaaaccagactcaaacggaaactacaaatgggagttccacaaaccatgggaaaaattcaccaaagaagcacaagacaaactaaatacgacaatagtatcgtttaaacaaaacacccgagtaattaataaaactgtaaataaatacgtttcctataaggatgaaaatggaaaccttaatgttgacgctaatggactaccccagaagaaagtaatcacgcaaactaaaggagataattgggcaataagaaaacccctccatgcagaaacagtatcaggaaaagtatttttaaaaagaattaaacaatcccatataacaatcgccaacgcaattgaacaggtcgaactcattgtcgataaagaagttaagaaacaacttaaagccaaaataaaactttatccaaacaacatagcaggactaaagaaacacctaaaagcctttcccgtaatgataaatgataaagcaattgataaaatacaaatctatgaaacattagaagccactgcgacgcgaaaaatattggacataacgttcgatgagaagaaaatacagaaaattacagatacaggcatacagaaaattctactaaatcacttaaaacaagaaaagtaccaaaatacagttgacgaaaacggaaagaaactagcaccccacgaaatagccttcagcgaaaacggtctagaagatttaaataaaaatataactttcctaaacgatggtaaaaaccatcaaccaataaagaaagtaagaattttcgaagaaggaaataagttccctctcggagaagtgggcaataagataaataaatttgtcgaaacagcaaaaggaacaaatttattctttgccgtatacgaaaacgacgacaagaaacgaaattacaagacaatcccattcaatgaggtcatagaaaggcaaaaacagggactgaatgcagcactagaaatcgacgaaaatggtaatagactcctatttaccctatcaccaaacgatctagtttatataccactagaagacgaaattgggtatcttaacggagtttatttcaaaaacctaaacaaagaacagacagtacgcatatacaagttcgtctcatgtacaggaggtgaaggtcacttcgtcccaaacaattactcaaaagaaatcattagcaacgaaaacggcagcaataacaaaaacgaacgtatgctcaatttcaataattttaatataattttcgatggaaaagaaaaaccggtaatgataaaaagcatctgctggaaactagaagtagaccggcttggaaaagtgatcaaaatcatcaaatga

SEQ ID NO: 9250 - RNA, 4617 nt, synthetic construct
  misc_feature 1..4617: note = Cas9 variant
  source 1..4617: mol_type = other RNA
atgaaacatatactaggcttagatttgggtacaaactctatcggctgggcattggtcaaaagcgagcaagactgtgatgacgtagagagaataaatggaatagaagcagctggaagcagaattataccaatggacgcagcggtattaggagacttcgcaaaaggaaacaccaaatcacaaaccgcagacagaacagctgcacgaggaatacgaagaatgggcgaaaggcacaaactcagaagggagagattaaatcgtgttctcgacgtaatgggttttctaccggaacattatagcgcagcgttaacgaggtatgggaagttcaaagacggtgaggaatgtaaaatagcatggcgaaaggacgaatcgggccaatggacatttgtctttgaggactcgttcagagaaatgcttgcagatttcgttgcacatcaacctgaatggctagcaggaggaaggaaagtaccatacgactggacaatatactacttaagaaagaaagcactcagtaaaccactaacaaaacaagaactcgcatggctcctcttaaactttaatcaaaaacgaggttactatcaacttagaggagaagatgagcatacagacgacaaaggaaaattagtagaatattatgcattaaaagtagtcggtgttgaagacacgggtgataagaaaggtaaagacacatggttcaatataatgctcgaaaatggaatggtttatagacgaccggctgcagaagcgcctgactggattggaaaaactaaagaatttatagtaactactgacttggaaaaagatggaacaccaaagaaagacaaagaaggaaacataaaaagatcttttagaatgcctaaagaggacgattggacactaattaaaaagaaaaccgaaaacgatatcgacagatcaggcaaaacagttggagaatatatttacgatgcccttctagcagatccaacgcagaaaataagaggaaaattagtccgcactgtagaaagaaaatattacaaagaagaattaaagaaaataattaattcccagaaaaggttcataccagaattaaatgacaatgaattgtatggacgctgcatttctgagttatatcagagcaacgacgcatacagacaaagcatatcgagttgtgatttcacatacctattcgtcgacaacattatattttatcaacgacctctaaaatcaaagaaaagtctcattgataattgtccgtatgaagaacattcttatacagattcaaaaaccggtgaagtcaaaacagctcctgtcaaatgcgtcgcaaaatcaaatcctttatttcaagaatttagattatggcaatttgtgcagaatataagaatcttcgagagacagaaaaagataggagatagcgtaaaaactgacgtcgacgtaacaggtgagttcataaaatctgcagacgacgtagtttcattatttgattttcttaatgacagaaaagacattacacaatctgtactcttgggaacatactttaaaatcaagaaaccaaaaggaaaagacagtgactatccttacagatggaactatgttgaagataaaacttatccatgcaatgaaactcgtgcactgatattaaagggcctaaaagacgctggaatagatgaagggtttttagataaagacaaggaatatagtctgtggcatatactatactcagtggaagacaaacaagaaattacaaaagcgatggaaaaatttgcagccaaaaatagtctaggtggaaaatttgcagaagtattctcctcactacctccattcaataaaaattatggatcatacagtgaaaaagcaataaagaagctgctggcactaatgagaacaggcaaatactggtcagcagatgcaatagataaacacacgctagaaagaatcgataagattataaatggcgaatatgatgaatcaataaggacaagagttagagaaaaagctataaatctaacagacgtctctcacttccgaggactaccgctatggttagcatgttacattgtatatgataggcactcggaatcaaaagacattacatgctggaactgtccagcagacatagatcaatatctagaccactttaaacaacactcattaagaaatcctatcgtagaacaagtagtaaccgaaacgttaagaactgtacgcgacatctggagacaatatggaaaaatagacgaaatacacatagaaatgggcagggacatgaaaaacccagctgatgtacgagccaaaatgtcgaaaagaatgatagataatgaaaatgctaatctcagaataaaagcaatgctcgcagagttcgcagacccagacttcggaatcgcaggggttcgaccatacagtccaagccaacaagaaatgctgcgaatctacgaagaaggagcgttagaatctgtagacgaggtccctgatgaaattaatgaaataatctcaaaatttaaccaaactgatataaagaaacgaccaacgcatggtgaaataataaaatataaattatggcttgaacaaaaataccaaagtccctatacaggcagaacgattagcttgtccagattatttacggacgactatcagattgaacatgtaatacctcaatctagatactttgacgattccatgtcaaataaagtaatttgtgaagcagaagtaaaccaacttaaagatagaatgctcggatatgagttcataaaagcacatcatggcgaaaaggtattattatcgtcgggtgaaacagtgacaatattgacagcagaagaatacgaaagattagtgcaactcaacttcaggaagaacccagttaaaatgaagaagttactaatggacgacataccagataaatttattgaaaggcaattaaatgattcaagatacataagtaagaaaataaagagcttactatccaacatggtccgggacgaaggagaacaagaagacatcagcaaaaacgtaatagcatgtaacggagcaatcacagacagactaaaaagagattggggagtaaacgatgtgtggaaccacattatcttaccacgattcgaaagactaaatgcagtaactggaagcgacagattcactacaacatcgacaaacggacatacaatccccgatatgccactcaaccttcaaaaaggttttaataagaaacgaatcgatcacaggcatcatgcaatggatgccatcgtaatagcatgcacaaccaggtcccacgtcaacttactaaataatgaagctgccatgagcaaaaacaatgctgtacgctatcaactctcaagaaaactgcgacgatacgaagatacaatggtaaccagaaatggagaaacaagaacaatcagcgtagcacgagagttcttgaaaccatggccaacattcaatgcagatgtcgaaaaagcactaaggggaatcgtcgtgtcattcaaacagaatttacgtgttataaataaaaccgtcaataaataccaaaaattcgtatataatgaggaaaaacatataaaagagaagaaagcagtaagacaagaagaaagaaatggaagacacttactagcaataaggaaacctatgcacaaagataccgtgtacggagaagtaaacctccgaagaatcaaagaggtaagtttaaaggacgctgtagccaacccaaaagcagtcgtagacaaagatctcaaaaagaaattaatggcaatgatagaattaggatatgacttgaaacaaataaccaaatactttgaagataacaaagatgcatggcaggacgtgaacctgaaaaagataaaagtatactactttacgaaagacacaggagatagatattttgcaactagatttggaaacgatctagtaacactatttagtaaaatcacaaaagccgacgacgctaagaaacaaatagaacggattacagacaccggtattcagaaaattctaaaacgacatttagaggctaacggcggtgattgtcaaaaagcattctcggcggacggcattgacgagatgaacaggaatattacacaactaaacggcggaagaccacataaaccagtatataaagtaagaatatatgagaaagccgataagtttgcaatagggactaagggaaataaagcagcaaaatttgtagaggcagccaagggaacaaacttattctttgcagtctatttgaaagaatacgaagatagtacgacgggggagaccattaagaaaagggtttttgacactatcccactaaaaacagtaatcgataggcttaaaaacgggcaaactccagccccagaggaaaaagacggagcaaaactactattcgttctatcacccaacgatctagtatatctgccaacggaggatgtagttaaaaatggaacaataaatagaccattagacaaacgtcgaatttataaaatggtaagttgtacaggaacagaatgttactacataccctttatagtggcaagccctatagtcgacaaagtggaatttttcagcctaaataaaatagggagagcgattacaggagagatgatcaaagaaatatgcataccaataaaagtagatagattaggaaacataactgaggtaaataatgagaaaatctga

SEQ ID NO: 9251 - RNA, 4623 nt, synthetic construct
  misc_feature 1..4623: note = Cas9 variant
  source 1..4623: mol_type = other RNA
atgaacaaaatacttggactcgacctaggaacaaactcaataggatgggctttagtaggtacagatgaagaaggaaatccaatacgaatatataaaagcggtagtagaataatacctatgtcacaagacgtgctcgggaactttgaccggggaaatagtatatcacagacagccgaaagaacgagctatagaggagtaagacgactcagagaaagacacttactgagaagagaacgactacacagagttttacacctaatggggttcctaccttctcattatgaagaagcaataggttgggataaaggagacaacaaaacatttgcaaaattttattcggatacagaaccaaaactcccttggaggaaaaacgccgaaagagaacatgagtttctatttaacacaccctataacgaaatgttagtagactttcgcaaaaaccaaccacaactcttcaaaatcaagaaaaacggacaagaatccttaataccatacgattggacgatatactacctaagaaagaaagcattatcaaaaccaatatctaagaaagaattagcatggataatacttaacttcaatcaaaaacgaggttattatcaattacgaggggaggaagaggaggaaaattcaaataaattaatagaataccatgctcttacagtagtcaaagtcatagcggacgaaccacaaaaaggaaaaagtgacatatggtacaacgcagaactagaaaatggatgggtctacagaagatcaagcaaaaccccgctattcgattgggagtctaaagtgaaagagttcgtagtcacaacggacttgaatgcagacggaagtttaaaagtagataaagaaggcggtgttaaaagatcattcagagtaccatccgaagacgactggatgcttgtcaaaaagaaaacggaatcagatatagagaaatcagataaaaccgtaggatgttacatatacgacacaattctccaaaacccctcccagaaaataagggggaaacttgtacgtacgatagaacgtaaattttataagaaagaactgactgaaatactaaataaacaaaaagaatttcacagtgaactacaaaataaagaactatatcaagaatgtataaaagaactgtacccacataatgaagctcactacgactcactattagtcaaagactatacagatttattcgtaaacgatatcatattctatcaacgccccctaaaaagtaagaaatcgttaatatcaaactgcccctatgaatatagagtctatagaaatgactctggaattgtagaaagagttcccataaaatgtatagctaaaagccacccgctttatcaagaatttagattatggcaattcatacacaatctaagaatatatgagagacaaagagaagtcaatggcaaaccggaaacagatgtcgatataacagcagaatttatcccaactacagaagacagggttaaattattcgattggctgaacaataagaaagaaataaaacaagatacactccttcaaagctactttaaaatcaaaaagaagaaaggagacgataaattcccatatagatggaactatgttgaggacaaagaatacccttgcaatgaaacaagggcattaatactctcgaggctaacaaaactcaacttatcagaagactttctaactaaagaaatggaactagcattatggcacatactctattccgtcgaagacaaagaagaaatcaaaaaggcttttaaaagttttgcacaaaaacataacctagatgacagctttgtagatcaattcataaaatttcctcctttcaagaaagattacggcagctacagtgccaaagcaatcaagaaactactacctttaatgagaataggcaaatattgggacgaaaaagccattagcggaaataccagatctagaatactatctatcaatgaaagattggaggatatgcggagtagcggcaagaaaattgaagacgtatccgatgacgacataccaaaacaagttttaaaatcattcgacaaagtaaacggagtatacagcggattaaacacataccaagcatgctacgcagtatatggaagacatagcgaagcaagcgaaataacaaaatggaaaacacctcaagacatcgacgattacctaaatgaatttaaacaacactcactgagaaaccctatcgtagaacaagtaataacagaaacactaagagttgttagagacatatggaagaaatacggagatttctccgaaattcacatagaattaggaagagaaatgaaaaatccagcagataaaagagcgaaaatgacaacacaaatctcggaaaatgaaaacaccaacctgagaatgaaaagtctgttagcagaactaaagaaccataatgatgtagaaaatgtcagaccatacagccccagtcaacaagaaatactaaaaatttacgaagaaggagtattaaattcagtttctgaaataccagaagagattattaaaatcactaaaagcagtcaaccaagtcaaacagagcttgtcagatacaaattatggcttgaacaaaaatatcgatccccatatacaggtgaaatcatccccttgggaaaattatttaccagcgcttatgaaatagaacatgtaatcccacaatcccgctacttcgacgattcattatctaacaaagtgatatgtgaaagtgaagtaaataaattaaaaggaaacttattaggatatgaatttgtcaagaatcatcatggtgtcaaagtagaactcaattttaataagacagtcgaaatattctcaataaatgaatacgaggaatttgttaaaggaaactacggcaaaaaccgaggcaaaatgaagaaattattattagaggacatccccaagtcatttatagaaagacaacttaatgacacaagatatatctcaaaggtggtaaaaggactcttgagcaatatagtccgggaagacggtgaacaagaggctacttccaagcatgttataccttgcacaggcggcgtaaccaccatattgaagcaagattggggtttgaacgacgtatggaacaaaatagtaaccccaagatttgaaagaatgaacgaactaaccaacacatctttattcggacagtgggaaaacaaggaaggaaagaggatttttagaacggaggtacctttagaacttcaaaaaggatttaataagaaacgaattgaccatcgccatcatgccatggacgccatagtaatagcctgcgcaacgaggtcccacgtgacatatctaaacaacgaatcgtcaaaggcaaacgcgaaagaaatcagagatggattaaaacataaactctgctttaagtctaaaactgatgaaacaggaaattataaatggcagtttcataaaccatgggacacatttacacaggacgtacaagatacattagaaaacatagtgatatcattcaaacaaaatttaagagtaataaataaaactactaaccgataccaaaaatatgaagaggagaagaaaattctaaaatcacaagaaaaaggagattcctgggcgattagaaaaccactacataaagacaccgttttcgccaaagtatccttacagaaaataaaatgcgtgaaactagccatggcacttaaagattggaaaaacatcgtagataaacaattgaagaaagaaattaggaggctaattctatcatacggaaaattcgacgctgaaatactaaacaaatatttcaaagacagaaagtacatatttaaagatgtagatataagtaaggtagatgtctactatttcgaaacagaatatgtggcaacaaggaagaatctagacacttccttcgataggaaaagtatagaaagcatcacggatacgggtatacaaaagatattactaaatcacttaggagtgaaaaacaataacccagaactagctttttcggcagaaggtattgacgaaatgaaccaaagaatcgtagaactcaacggcggcaaacaacaccaacccatttataaagtacgtatgtatgaacccctgggtaataaattccaagtaggcaggatcgggaacaagaaagataaatacgttgaggctgcccctggtactaatctcttttatgctatctatcaaagcgaagataagaaaagaatctacgacacaatcccacttaacataattatcgaaagacagaagaaagaattattccctgttccagaaaacaaagaagataaagataatttatataagctgctattctggttatcaccaaacgacatggtctatctacccaccgaaaaggaatgggccaatccagatctttttaacttcaacaatatgaccaaaaaccaaagaaagaaactctacaaattcatcgacggctcaggaaccacagcgaacttcatacccaacaccgtagcaaacatcatattcagtatacccaagaaagactcaggcaaatacagtatgggaaatagaatagtgcagaacgaatttggaattgggagcccccaatctaaaaaccaaaaggctttcacaggggagatgataaaagaaagatgctggaaactaaaaataaaccgtcttggtgacataatagaatgcataaaatga

SEQ ID NO: 9252 - RNA, 4629 nt, synthetic construct
  misc_feature 1..4629: note = Cas9 variant
  source 1..4629: mol_type = other RNA
atggaaaaacgaattcttggactagacttaggaactaattcaattggatgggcattagtaaagggagaaaggcatgaaaatgacaatgaaacaatccttagttatattgaagccgcaggaagtagaatattaccactcgatgcagcagcacaaggggactttgagaaaggaaacccagctaaaacacaaacttcagaacggacacgaatgagaggtatgagacacctactagaaagaagcctcctaagacgagaaagacttcacagagttctagacataatggattttttaccgccacactacagccaaagcttgacaagatacgggaaattcaaagcagacaccgaatgcaaactcgcatggcgaaaaacagagactggtcactatgagttcttatttcaagacagtttccaagaaatgcttcaagattttcaaaaccacgggaagttagaagaaaacaaaaaaatcccttatgactggacgatatattatctgagaaaaaaggctctaacgcaaccagtttccaaacaagaactcgcttggatcctactaaactttaatcaaaaacgggggtactaccaaagagaagaccaagcagtagacgataaccaaaaaaaaagagtagaatatcaagcactgaaggtcatcagtgtagaagacacaggagaaaaaaaaggcaaaaacacgtggtacgacgttcgattagagaatggattagtatatcattattcagcacccattaagccggactggaaaggggaaactaaagaattcatagtcacaacaactatagaccaaaatggcaaacctgaattggataaagatgggaaaccaaaatattcaatgcgcgcccctaaagaagacgattacaaattacttatggaaaaaacaaaaaaagatataactgatagtggaaaaagtgttggtgaatatatctatgatgcgctattggtaaatccacaacaaaaaatcaggggtgggttagtaagaactattgagagatatttctataaaaaagaactagaaaagatactactctcacaagagagatttattcccgaactaaccgaccgagaattgtatagaagatgcgtcgaggaactttatccatcgaatgatgcttatcgacatttaatagaatcaagagacatgaggtacttactagtcgaagatatccttttttaccaaagacctcttaaaagtaaaaaaagtcttatagatgattgtccctacgaaagtagaagctatgtcgatagagaaacaggagaaataaaaagttcgccagtaaaatgtatagcacaaagtcatcccctattccaagaatttagattatggcaattcatacacaaccttagaatataccaaaatgagagatcagtagaaggcaaattacaacttgatgtagatgtcacggaagaagtactgccaacaccagaaagcaaagcagctctatttagattcctaaatgatcgagaaaatgttacgcaagaaatactcctaaaagaagtatttaaggggagaaaattatcagtgaaagattgcccttatagatggaactacgccggagaaggaaaaaaatatccctgtaacgaaacaagacacttaatgttaaaattattgaaaaaagccggaatagatacagcgtttctaacacctgaaaaagaacaagcgctttggcacataatgtattcggttgaagacaaagatcaatacgaaaaagctttatcgacatttgccagaaagaatgacctgcccgatggctttaaagaacaattcaaaaaggctccaacattcaaaaaagactatggggcctactcattaagagcaattaaaaaattattaccgctaatgagagtaggagaatactggagtgcagactgcattgacagcgagactaaggaaaggatttcacaaataatcagaggtgagatggatgaaaaagtctctcaacgaatgactaaatcgagagactccttcaccgatattagtcaattccaaggattgcccgtttggcaagcttgttacgtagtatacggaagacatagcgaggccacagaaatacagcgctgggaaaaaccagaagatatcgacgtctatttaaaagcttttaaacaacactctctacgaaaccctattgttgagcaagttgtactcgaaactctgcgagtcgttagagatatttggaaaacgtacggtaaagtagatgaaattcatatagaaatgggaagggatatgaaaaacaccgcagaagaaagaaaaagaatattcaatagaaatcaacaaaatgaaaatgataacctacgaataaaagcattactaacggaattcatgaaccctgactttgaaatagaaggagttagaccctattcaccaagtcaacaggaagctttacgcatttacgaagacggagcttggtccggacttgatgaagaaaaagaagataaaaaagaactagaagcaattagagagatcctaggtaaattctcgcaatcagacaaggcgaaaagaccgacacacagtgaagtattgagatataaagcgtggctagagcaaagatacagctcaccctatactggtgaggccatacctcttgctaaactttttacaccagcttacgaaatagaacacgtaattcctcaatcaagattcttcgacgatagcttctcaaacaaagtcgtatgtgaagcagaagtaaacaaattgaaagacagaatgttaggctatgaattcataaaagctcatcaaggagaagtggtaagtcttagcggaacagggagatgcgcgagaatattgtcgccagaagagtatgagcaaagggtcaccgactgttacaaacataacactgccaagatgaaaaagctattgatggaagagataccagacgacttcatacaaagacaaatgaacgactcacgatacatcagcaaactggtaaaatcgctactaagcaatatggtacgagaagagggtgaacgagaagcaataagcaaacatgtgattacttgcaacggcacgattactgatagactaaaaaaggactggggggtcaacgatgtatggaatcacatcatattaccaagattccaaagaatgaaagacctaactgggagaaacgattttgtagcagtaaattcacaaggtcatgaaattccttcagtaccacctgagctccaaaagggttttaaaaagaaaagaatagatcatagacatcacgctatggacgcgatagtgatagcatgcacaactagaaatcatgtaaatctgctaaataacgaagcggctatgagtgaaaataaagcaaatagaattgccttaagcaggaaactgagaagatacgaaaattgcgcaatttataaaggaggagaaacaaagaatataagcgtagcgaaagagtttttaaaaccgtgggccacgtttccagcagatgtggaaagggcactaggagacattgtagtaagctttaagcaaaatttacgggttataaacaaagccacaaaccattacgaacattacaaagacgggaagaaagttaaagtaccgcaaaaaaaaggagacatgtgggtagtccgaaagccactgcataaagataccgtatatgcactagtcaatctacggaatgtaaaaacagttgggttaaaagacgcaatacttatgccagatagaattgccaacaaagacttaaaaaaaaaagttaaagaactactcgctcaaggtgacgacctaaagaaaataaaaaaatattttgaaacagaaaaagatacatggcaagatgtagacgtaaaaaagatcgaagtatactatttcagcgaagagactgcaaaccactattatgcaacgagaaagccctttgatgcgaacgtaaaaatcgacagcgtaactgacactggaattcaaaaaatactccgaagacacctagaagaaaatggaaacaaagcagacgtagcattttcgcccgaaggaatcgcacgtatgaatgaaaatatattccgccttaatggaaataaacatcaccaacctatatacaaagtaagagtttacgagaaagcgaataaataccccgtagggcaaaccggcaataaagcatctaagttcgttgaagcggccaagggtacaaacctatacttggcagtatatgaaagtgaagtagtagacaaaaagaccgcagagatatcaaaaaaaagaagttacgtaatcgtgccattgagagatgctgttgcacgtcaaaaacaaggagtgccggttgcgccagaaagaaatgaagaaggcgggaaacttctatttgtattatctcccaaagactttgtatatgtacccacagaagaagaaaggtcaaaaggagaagtactgctaccattagataaaaatagaatatatataatgatggatgcttcagacggtattgtcaattttttaccatactcagtagcaaatttaatatacgcacttccgaaagaccaagcatcaggattctgcacagatggtaggatgatacaaaatgagtttggactagggtctccaaaatctaaaaatgaacgagctttaacaggagaaatgataaaagaaatttgcttaccagtaaaggtagatagactagggcgtataaccgagatcaatgggaacaaggtatga

SEQ ID NO: 9253 - RNA, 4644 nt, synthetic construct
  misc_feature 1..4644: note = Cas9 variant
  source 1..4644: mol_type = other RNA
atgaagaaaatactaggattagatttaggtacaaactcgattggatgggcattaactaacaatgactttgacaataaactaggaagtatagaaggactaggatccagaataataccgatgagccaagatgttctcggaaaattcgactccggtgtatcaataagccaaacagcagaaaggacaaaatacaggggaacaagaaggttagtccaacgattcttattgagacgcgaaagattacacaggattctaaatatattagactttcttccacgacattattcggaagcaattgatttcgataagaaattcggtcaattcaaaccagaaagagaagaaaaactaagtttttataaaaatgaatcaggcaaaaaccaatttttatttctagaatcgcaccaagaaatgtttagtgagttcaaactaacacacccagacctgaaacaagttccgtacgactggacaatatattatttaagaaagaaagctctcacccagaaaataagtaaagaagaactggcatggataatactaaacttcaaccagaaaagaggatactaccaattgcgaggagaagaagaagaagtaaacaaaaataaactagaagaatttcacaccctcgtaatcgttgacgtaatagaacgtgaaaaagggaaatccggtgtatggtataacgtaatccttgaaaatggatggatatataaaagagaatccaaaatagcactgtttgattggattggaaaacagaaaaattttatagtaacaacagaattaaatgacgacggaacaataaaattaaacaaagataatgaagagaaaagatcatttaggtcaccaaaagaagacgattggggactcagaaaaatccggaccgaacaaacaataaatcaatcagaaaaatccgtaggttcatttatctacgacgaactactaaagaaaccaaaccagaaaatcaaaggagaattagtacgaaccatagaaagaaaattttacaaagacgaactctccaaaatcctaaaagcgcaaataacatttcattatgaaattctcggagatagaaatatttacaagaaatgtatcgacgaactataccgacacaatgacagtcacaaaaataatatcaaagataaaggattcgactatttattcctagacgatataatcttttaccaaagaccattaaaaagcaaaacatcgcttataagcgactgctctttagaatttgtaccaatcaaagacaagaaaggaatcctagttaaagactcaaacggtaaacaagtagtaaaaccactaaaatgcatagcaaaaagtaacccaatatttcaagaatttagactcttgcaattcgtcaaaaatttaaaaatatataagaaagaaataatcaacgaaatagatgtaactaatgactacctgaaaacagaagaagacttagtagaactattcgactggttaaacgataaagctgaaatttcacaaaaacaatttctagcctatccaaaattcaagctaaaggaagacaaatacagatggaacttcgtagaagacaaaatatacccgtgtaatgaaaccagaaaccaatttcttaatgcgatcgcaaaaatcgacgtgaataaatcgtttttcgatgccaaaaacacccaagacttatggcacatactttactctgtaacagacaaaactgaactatttagcataaataccgaaactggaatacaatccggcgcattgagcacattcgcaaaaagacataacctatccaacgagttcgtttctaatttctcaaagataaaaccttacaataaggactatggctcttattcagaaaaagctatcaagaaactccttcccctaatgcgatttggcagtaactggaataaaaacaatatagacgcaaaaacactagctagaatagacaaattgcaaacaggagagtttgatgagaccatgagaacaagagtaagagagaaagcaatacacctatcaaagataaccgattttcaagggctacctttatggctcgcatcttacattatatatgaccgacatagcgaggcatcaaatatcagcaaatggaagaccccggaagacatagcgtggttcctaaaccccaaaaacaaatcagggtttaaacaacactccttaagaaaccccattgtggaacaagtaataacagaaaccctccgagttgtaaaggacatatggcaacactacggtgaaggaaaagaaaatttctttaacgagatacatatagagctaggcagagaaatgaaaaacaacgcaaatgacagaaaaagaataacggaaacaataaatcaaaacgaaaacacaaatttacgaataaaggctatactcacagaactcaaaaacgatggaataaacgatgtgcgaccatactcaccaagtcaacaagaaatactaaaaatttacgaagagggcgtatacaattcagaaatacgaaaagaaaagttggaagacatagataaaataagaaagaacgctaaaccaaccccttctgaaataattaaatacaaattatggctcgagcaaggctatatatcaccatatacagggaaactaatcccactcagtgatttattcacgacaaaataccaaatagaacacataattccccaaagtcgcctgttcgacgatagtctttccaacaaagtaatatgtgagagcgaagtaaacgatttaaaaggcaacaatactgcgctagagttcatactaaagaatgaaggaagaatcgtacttttaacgggaggtaaaacagtaaaaatttttactaaagaagcatataatcaacatataacaagctactatatcaaaaataaatctaaacagaaaaggttgcttacagaagaaatacctgagaaattcatcgacaggcaattaaatgatacaaaatacatctccaaaatagtcaaaaatctattatcaaagatagtaagagaagaagacgaacaggaagtaacatccaaacatatcgtctcattgaacggtagcattacaagtcgaatgaaacaagattggggtctcaatgatgtgtggaacaaaatcgtaagtcccagatttgaaagactcaatgcaattacaaatagtaacgactttggaaaactggaactcaagaaagatgagttcgggaacgcggggaaacaagtatttcaaacaaccgtaccagatgatattgcaaaaggattctcaaagaaaagaatcgatcacagacatcacgcattagacgccttggtaatcgcttgtatcaatagaacacatatcaattacttgaacaacttaaacgccaaagatgagaacgataaaactatcaagcacgaactcaggaacaaactatgtttcaaaacaaaaccagattctaacggaaatagtaagtgggaatttcacaaaccctgggaaaacttcaccaagaaagttgaagacgaactgaaccaaacaataatcagtttcaaacaaaacacaagggtcataaacaaaaccgtgaacaagtatcaagtatggaaagaagaagacggagcaatgaagaaagtaaccgtcaaacagacaaaaggagacaactgggcaataagaaaacccatacatgccgaaacagtaagcggcaaagtatttctaaaaagaatcaagcaatcacatataacgatagcaaatgctattgaacagattgagttaatagttgataaagaagttagaaaacagttaaaggccaaaataaaacaatatccaaacaacaaagaaggttttaaaaagcatttaaaagcgtttccaattatgatcaatggaaaagctatagataaagtacaaatatacgaaacaatagaagcaacagccacaagagagagaaataatctcgatattacatttgatgaaaagaaaatcgagaaaataaccgacaccggtatacagaaaatattactaaatcaccttaaacaagaaatataccaaaatgctatcgacgaatctggcaagaaaatagctccacacgaagtagcgttcagcgagattggcatagacgaactaaataaaaacataaaagtgttaaacaatggtaaaaatcatcagcccatcaagaaagtcagaattttcgaagaatcgaagagatttagtttaggacagtcgggatcaaagacagacaaatatgtagaaactgcaaaaggaacaaacttattttacgcgatatacgaaggaaagaaaggaaatagaaattataaaactataccgttaaatgaagtaatcgaacgacaaaaacaagggctaaattcagcattagtcactgacgagaatgaaaaccggctacttttcactctctcaccaaacgaccttgtttatataccaacgaatgaagagaagaaaaacttaacaacaatcaatttcgataaactgtccagagaacaaacagaaagaatctataaatttgtcagctgcacaagcggtgaaggacacttcgtatcaaataattactcaaaagaaattatctctaatgagaatgggtcaaataacaagaacgaaagaatgctcgaatttaataactcgaatacaatttacgacgaaaaggaaaaaccagtaatgattaagagcgtctgctggaaactagaagtagatcgactagggaagatcaaaagaataattcggtga

SEQ ID NO: 9254 - RNA, 4677 nt, synthetic construct
  misc_feature 1..4677: note = Cas9 variant
  source 1..4677: mol_type = other RNA
atgaagaaaattcttggattagaccttggaactaattctataggatgggcactcgtcaacgtcgacaaaaatggaaatccgttcggaatcgaaggactagggagtagaattataccaatggaccaagccaccctatccgattttgaaaaaggaaactccaaatcacaaacagcagaacgtaccatgtttagaggagcaagacggctaagagaaaggaaacatctacgaagagaaagactacatcgaatactaaatgagttaaacttcctaccaatccactatagatcatgtatagattttgtacatcgattgggtaaattcaaagcaaatcacgaaccgaaaatagcatggcgaagtaacgaccaagataaaatggaatttatctttcagaactcatttcttgaaatgatgtcagacttcactaaaaggcaacctgagctcgtaaaagagggaaagaaaattccttatgattggacgatttacttcctccggaagaaagcactaggccaaagaatagaaaaagaggagttagcatggttactactccacttcaatcaaaaacgaggatactatcaattacgaggagaagatgaaattgatgcaactaggagtgcaaaaacgaggaaatattttgatagaaaaataatcaaaagtataattgacaccggagaagaatacaaaggcctaaaagtactcatagtagagctagacaacggaaaccaaggaaaaatatttaaacaggaagtacccgactgggtaggacaagaaaagaacattattgctactgtagacctcgataaagacgggaaagatcgatttgacaagggagtcttaagccaacgattctcaataccatctgatagcgagtgggaaactgagtggaaactcataaagttaaaaaccgaagaagacttagaagccagtcagaaaacagtcgggacctacatttacgactcactactaaagaacccaaaccaaaagataaagggaaaattagttcgaaccattgaaagaaagtattacagagacgaattgcgagcaatccttaataaacaacgtgagttccatccagaacttaatgacaaaaagttatatcaacattgtattttctcactttacccccaaaacgaagcatttagaaactcaatagcaaacaaagatttcacttatttattcctagaagacataatattctatcaacggccgctaaaatctaagaaatcaacaataaataactgtgcctacgaagtaagacgatatatggacaaagaaaccaaagaacttaaagaagtccccttaaaatgcattgccaaatcacacccgatatttcaagaatttagattatggcaattcatatcaaaccttagaatatataagaaagatatcacagatatagacgtcacaaatgatttcctccatagccaagacgattatgcgaacttatttgaatggttaaacaacaaaaacgaaattgatcagaaagcatttttaaaatatccagctttcggcttcaagaaagatgcagtaaattaccgatggaattacgttgaagacaagagttatccatgtaataaaactcgctcagctatactaagtaaacttgacaaacacgaacaagaatttctaactaaagaactcgaattgaaaatttggcaacttctatattctgtcaactccaaagaagaaatagacaaagcattaaatgtaaactctcccaaaattaacaataaaatatctatagaccataccggcatacttcatgagctaaaaagctcctcgctctctgacatcagtatccaaagactcaaggcgataaactttgaagaaaaggactacggctcttattcctataaagccataaagaaactacttgcccttatgcgacaaggaaaatacttcgataataccgcaattacagacgctacaaaagcaaggataaatagcatctttgacagacttgaatcgatatcgtttgacccagaacgtataaactcaataagtgatgatgacatacccaaacaaatcttaaaatccttcataaaactcaacagaacgtacggaggttttaacacatatcaagcatgctacgcagtctacggtaggcactctgaagcaaaagagatagcgaaatgggaaaaacccgaagatatagatcagtatctcgcaaaattcaaacaacacagtttacgcaatcccattgtcgaacaaatcatcacagaaactctaagagtcgttagagacatctggaagaaacatgcttataaaaccataaacaaagataaccaaggaaacaactgcgaatcagaatctgagctaacagaaatacacatagaactaggcagagatatgaagaacaataaaagtgaacgactaagaatatcgagaataaacagcgagaatgaaaacacaaatctaagaattagaaaacttctaattgagttcaatgaccctgaatttggagtagaaaacgtaagaccgcattcaccttcacaacaagaaatcttgcgcatatatgaagacggagtcttaaagagtggagttgaaatacccgaatacgtagataatataataaagaaatttaaagaaacagacgtaaagaaacaaccttcaaaatcagaagtcttaagatataaattatggttagaacagaaatatcggtcaccatacactaacgaagttatcccccttggcaaactgtttacaaacgactaccaaattgaacatataataccccaatcccgctatttcgacgactccttctcaaacaaagtaatctgtgaagccgaagttaaccaattaaaagaaaatgagctaggctgtgaatttataatgaacaacggaggaaggatagtagaactatcttttggtaaaactgttagaatattggattttgaagcatacgaacaattcgtacaacaaaactacgcaggaaatcgaccaaaattaagaaatttattaatgacggaaattccaaatgatttcatagatcgacagctaaacgactcacgatacatatcaaaagtagtaaaaggattactatctaacattgtcagagaagacggtgaagctgaatctacatcgaagaatctgatatcttgcactggaggagtaacggcaagattgaaaatggattggggcctaaatgatgtttggaacaatcttatttatccaagattcgaaagactcaatgaactaaccaattcgaatcaatttggatattgggataagaaagacggtaaaaacgtcttccagacacaagttcccatggacatccaaaaaggattcaataagaaacggatagaccatcgtcatcacgcattggatgctttagtaatcgcatgcgcaacacgtagccatataaactatctgaataacgaatctgccaaatctaactctaaagaatcgcgatatgatctaaggagaaaattacgaagactagaggtaatacaaaaagaatacactataaatggaaggaaggaaataagaaatatagaagtagctaaagaattttataagccctggaacagcttcactcaagatgcacaaagcgcactagaaaatatcgtggtgtcatttaaacaaaacctccgggtaataaacaagacaacaaattacttcttacgattcaataaggaagggaaaaagatattcgaaacacaaacaagcggaagcaactgggcaataagaaaaccattacacaaagacaccgccttcggactcgtcaatctaaaacgaacaaagacagtatccctcgcaaatgccatattggattacgaccagattgttaatcgaaaactatggaccaaaatcaaagaattgatatctataggctatgacaacaaacggattctaaaatatttcactgatgataaggaaaactggaacgaaataatatcgtcaggcatagaagtcttttactacaccgataatttcgaaaaacaggtagcaacaagaaagccactagatactagctttacagaatcaaaaatcataaactcaataacagacctcggcattcacaaaatactactggctcacctcagggcaaatgagggaaacccaaacatcgcatttagtccagaaggcatagaaaccatgaaccgtcatatatgtgaattaaacggcggtaaattccaccaccctatctataaagtacgagtacatgaacccctgggttacaagtttaaagtaggagacaagggtaatcgctcaacaaaatatgtagaagcggctaaaggaactaatctattctttggcatctatataaactcccaaggaataagaagctatgaaactataccactcaatgtggcgatagaaagacaaaaacaagggctttcgccagtaccagacaataacgaactaggcgaaagactactcttttggctaagtccgaacgacttagtatacctaccaacatcagacgaagtagaatcaggtatatgttgcaacaaattaggtatagacagaatctacaaaatggtatcatgcacaggatatgtaggagactttatacccgcgcacattgcaaacccaatcatacaaactttagaattaggatcgaataataaagcacaaagagcatggacaggagaaatgataaaagaaatatgtatacccgtcaaagtagaccgcatgggaaacatagtagaaatatttaatagaaacaaaaattga

SEQ ID NO: 9255 - RNA, 4695 nt, synthetic construct
  misc_feature 1..4695: note = Cas9 variant
  source 1..4695: mol_type = other RNA
atggccaaaatattgggactcgatttgggtacaaattctatagggtgggcaatagtagatgacaaaaacagcaaaatattagatacaggcgtaagaatattcccagaaggagttgtagcaaaaacaatcggaagcggagataaagaagaaagcaaaaatgctaaacgccgagaatcaagacaaactcgacgtggcttttataggaaacgccttcggaaaattaaattactaagaacactgatcaacttcaaaatgtgcccattagaacatttcgaattagatgtctggagtaaatgggataaaatcaagaagaaagaaggtagaatggcaccagaactattcctgccagaaaattcggcatataacctttggctaaaacaaaatccatacattctacgagacaaagctctaagcaaagaccttacattaactgaatttggaagagtactatatcacctcatacaaaggcgaggatttttatcaaaccgcaaaggaaaagatgatgggaaaatctatgggggaaaagaaggaatcgtgggtatagacaaaactaacgaacaaatcaaaaacagtacgttaggtaaattcttatttaaaatattaccgaaagaaggagaaccatttaaaatcatagaagacgaactaggtaacgaactaagagtgcgatcccgctacacgctaagagacatgtacatagcagagttcgaagccatatggaaccgccaggcaaaacatttaggcctagacaacatctactacagcaatgtcaaaaatgttttattaaaaggatcgctcaaaaataagaaaaatgaacggaaaattaaccaccttaagaaaataaaaggcaacggcaacatagaaattataacgctaaacaacaacctatccaaaaatgaaaaaccaaaatacctgctgaaaatagctaccaaattaccattaaaagagttcttggcaggaagaatagaaaaagatgaagatgggaaaattaaattcaaatcaaacgaatcagtactgttctggcaacgaccactaaggtcacagaagaaattactcgccaaatgcagattcgaacctgaccttaaagatgataacggcaaattcatacaaaaaggaaaaacaccatgtcatttgtcacaccctctatatgaagaatacagagcgtatcaatatgtcaacaatatagaatacgggaagaaacaaagattagaagaatcccaaagaaaacaagtaatagaccttattaactccaaagatggaaatttcaaatttagtgaaatcaaaaagaaacttaaactgtcgtatgaaacatttaactattcagatgattcttctgtaaacggaaattatatgatcaaaaacttaaattcaatatttccaaaagaaatattagaaaaagagtttgtagtcaacgttaacaaagaagacataatagaatacggctacgagcgaatatggcatttatttcatttctgcgaagataacgacgtgttaattaagaaactacaagataactttgatttgtcagaaaatgacatagagaaaatatcaaaaataaacctaaaagaaggctacagtaatgtatcattaaaagcaatcaaaaacatactaccatatctaaaagaaggtaaacttttaagcgatgccgtcatcttaggtggagtccgaaatgtatttggtaagaaatggcatgagttcatcgatttccacgagaaaatagaaaaagatattttatacataaaccatcaaaagagcaacaaagaaggagaagcaatcgagaaaataaagaaatacttgatagattacaaattcgggttcacagaaaatgacaataggttcaagaaactatatcaccacagccaagacgtagtggaagtcaaactccagaagaaaatagggccggtcgaagatttaagaaacccaatagtgcaacaaggtgttaacgaagtgcgtcgccttgtaaacgaactccttgacgtccatggaaaatttgaccaagtaagagtcgaactaggaagagacctcaaaaacaataaatctaaaagagaagaaataggatataaaattcgtgaaaacacagccaaaaatgaaaaagctaaagaattactaattgaatacggtctgagacaatcccgtgataacgtccaaaaagtattgctattccaagaaatgttagatagaggaaccgtagcagtttgcccctacactaacaaaacaataaacatttccgacgtcctgggaaacgaaaataaaatgcaaatagaacacataataccgaaatcgataagcctcgacgactcattcgcaaataaaaccctgtgtgattcaaaattcaatggactcaaaggagaaagaacaccgtacgagttctaccaaataaacaatgatgctaatttatggggagggagcaaatcctgggaagagatagaaagaagaacctttcgaatactaccatacagcaaagccaaaagattcacaagtaaaaccaaattcgaaaccaacgactttatccaaagacaactaaatgacacaagatacataagcaagaaaactaaagaaatactatcacagatatgcgaagatgtaagagtcatgcccggatccttaacagcagaactaagaaaattatgggggttgaataatattctccacccagcatttgtacttgacctgcccgcattacacatagacgcgaataaacacataccccattatgtagtattggatgaagacaatgtacctatattaagtcaaagaatatacaacgacaaaccaatcttaaaagcaaaccaaacaagtataacaggattcgtagacaacgaaatttttaaaagcaaagagaaatacgttaaatttgaggtgaaagccccaaatctaagcaacggtgaatactgggccaaattgttactcagcaatcccaaatcaatagtacgtgtttttaaagaaaaacctaaaagtaccgaaaatgaaatcgtagtcagaggcaagatcgaaaaagaaaagttcaaacacgaaggactatcagggattaacgctgaaggaaaagaaaatggtacatactgggcaaaacttagcatagtagataagaaatttaagaaaccaaagaaagatgatcaaccaaagaaaaacggcaaacaaattctgttatttggagcagttaaagagggcgtattcagcagttatatgtatgagtgtgacgccgacttagaagacggaaaatactggctgatactcgatattgattttgaaaacgtagagttcgaaaaagcactaaacgaacgacccgaagtcctagaaaatcaaatcctcatacaaggcataacaaatgatgaaaatgtattcgttagtgacatggattgccaacaccaatttctaatgaatgaaggaaaaggaaaatattatgttctattcgacataataagtgaagtaaacgagttttatcccataaaaacaaaatctccagaattagaaaacggacaatcattaacagaaggtaccatatgggtagataaatacacaggggaaataaaattcgatcccaagaaaaatagagaggatcacagacaccatgcaatcgacgctctagttattgcactaacaaaagagacatactttcaacaattaagtcgacgtaatgcatcatcagaaaataagaaacgtggaaatgaatatgaaaaagaacaactcgacttcgccgaaccatggaaagagtttcacgtagatgctcagaaatccatcaactctatactcataagccataaacagaataaaaatatactaactaaaatcacaaagaaaattaccaaaaacggaaaaacatataaaagcgaaggaatgagtgtacgtggccaattgcacgacaaaacatactatggccacaataaaaactgcaaagcagacgaatacgtctaccgggtagacataaacaatcttagcttcagtcagctcactaatataatcgacttaaatttaaaagcagtcattgttgaaggcgtcataaagaaattcgaggaaagcgaaaaattactcttcaagaaaatgaactcaaaggttcaaaatcttgacaaatcaaaagtaaagaagatcaaggcaaaagtggataagatactaaaagaaaccagctttttcatgccaaacgaaggaaaacgctacatacgacttaacatcatcgaaccagcaaattttgagagaatgcccgtacccatcaagaaagtaagaataagaaaagtactacgaaatgccgagaaacttaataacgaaataaaacaatttgtagaccctcaaaataatcatcacgtactaatatacaaagacgaaaacggaaatctcaaagaagaggtcgtaaccttctggacagtagtagaaagaaaacgaaccggagaaccagtatataaattacctagtgatggcaaaaagatagtaacaaccctacaaattaacgatatgtttctcctaggattgaacgaagatgaaataaattgggaaaatccaaattataaccacttaaaagaacacctctaccgagttcaaaaatttacaagtggcgatttttacttcagaatagcaaaaacatcatctatacagaatggggaagaaaaacaacaaataaattccttcggactagggaaaaacggatggcttactcacaaccctataaaagtcaaaatctcggtctccggaaaaatcttaaaggtatga

SEQ ID NO: 9256 - RNA, 4713 nt, synthetic construct
  misc_feature 1..4713: note = Cas9 variant
  source 1..4713: mol_type = other RNA
atggaaaattcaaacaattcttctaagaaatattatttaggactcgatatgggtactgattcctgcggctggtgtgttacagacgacaaatataatataatccgttcgcacaagaaaatatacggaccagatggcaaacttgtaaaaagagaaggatgtcacttatggggaagtagactattcagaccggcaaacactgccaaaagtagaagattaaatcgaacagcgagaagaagacttgcaaggcgacgaagacgaataatactattaagagaactattccaacccgaaatagataaagtcgacccaaatttctttagaagactagaccaatcaaacctatggaacgaagacaaagataaagagctacaaatggaacacaacttcctatttaatgataaagacctaaccgataaagaatattataaagattttccaacaatatatcacttaagaaaagcaatggtcaacggcctgacaattaacggatattattacgatcccaagaaacaatttgatataagagaagtgtatttggtactagcccacatgatcaaatacagaggaaacttcctcatggaaggagacgtaaaagattctgtggtcgacccaacatatttaaaacaatgttttgataatattgacgtaatcctaatatcactgaataacggagaagatgacgaaaatgaagatgataaaatcgatccatcagaatgctgcttcaatgttgatgaaaagaaagctagaaaactcgcgaataatttccaagaaaccaacaaagtatcggatttagaagatgatgaaagagacttatttggaaaattcaactcaaaagatattaggaagaaaatattaaaattaataaacggaggatctggtgtgaaattaaaagattttctacctaaagaaatactggttgcccatgacggtgacgatgaatatggagacaagaaaatcgatctatcatcagaaacattagaagacgacattaatggttacagtctaccagaatcatacgttgaaataatattagaagcaaagaaaatatatgacttcaaaactttagcctatttactacatggaaaatcactactatgtgacgctatggtcaatgtttatgaagaacacaaagaacaactagcagcactaaaacgattatataagaaatatgccacaaaagaacagtactattttatgttcagagacagcagaatcttagatggagatgactcagatgacgaggaagacaaagaggaatcaaacaaagaagagagcaaagacaaaaagaagaaagcaagctatgtctcctacatcggatacacgaaaacaaactctaaagcaaaatacacaggtgcccacattacaagtgagaaaaatatatctgccctaataaaacaaattaaagacgatctgaaattcgacgacttgaaatcaaaagtagatgacccttctcaacaaaacgaactatcggatgaagataaattagatatacagtgtatagaagaagcaatagaatctaacacttttctgcctagacaaaactccagaaataacggagcgttcccataccaactaaatttaaatgaaatgagaactataattgaaaatcaaagtaaatactacccattcttaaaagacaaagccccgagtttccccgatggaaaaacagaagaatacaaaatcgtcagcttactgaaattcaaaattccctactacatcggaccattaagccaaccaaacgactatgtcagagacgacaaaagagacaatcactgggtccaattccgaggggaaaataatcaaggaataataaacccctggaatttctcacagattgttgatttagaaggtaccgccgacaaatttataagtaacctaaccaattattgcacttacatatttggtgaaaatacactaccaaaagagagtctaatcttccaagcatacaaagttctaaatgatttaaacaacctgaaagtaaacggctcactaatatcaaaagaagataaagactacataatacaaaacgtatatcttaaaaagaagaaaataaaaggcaaagacatagtaaacgcactgaaaaacaaatacaaactatcagacgaagacccaactgtaacaacaaaaggaagtggaaaaagtataggcgaagatgaagtcgatctaactatgtttaacagtagcttatcatcttttatagacatgagtgacccaaacgcatttgggcccgaattttataaagatagcaacaaatttgaattagcagaaaaagtcatagaacttataacaatagtagaggacaaagatttattaaaagagagactcaagaaattaggcctcagcgataatcaagtaaactacctttttaaacagaaatatagtggctgggcaccactatcacggaaacttctagatggaataactattgactgcgttaacgagaacactggagaggcctaccctgtgacaattattgatgtaatgagagatacaccgctaaacttcatggaaatttatgagacaaaagaatcccaattttcaggttttaaagaaaaagtcgcagaactcaacgacgagaagaaactaagcagggatgatttaatagaagaatcatacgcctccccagcaatgaaaagaagcgtcagacaaacattcaaagtcatcgacgaactaaagaatacattaaacattgaccatttcgatcgcatatttgtagaagccacgagagcgccaggtgaagccggaaaaatggtaaagagtagaaagaaacaactacaagaggcatacgatgcagcaaaagatctcgtcgaccaagaaagcagggacgacctccaaaaattacgagatgatcttgaaaaacaaacagatgaccagctacgacgaaagaaagtatacctttattttatgcaactaggtagatctgtatactcaggtgagaaaattgatttaaacgaactggataaaaattacgacatcgatcacattataccacaagcaaaactcaaagacgattcctttaataacatggtcttagttgaacgtgaattaaataataagaaacaagacgaatatccaatcccatcaacaataatatccgagcatggaagaaactggatacaaaaacttgcgaaaatccaagacaagaacaaacgaagttactttatgcctaaagacaaagccaaccgattactaaggcccgaatcaaaacaattgactagcgacgaactaaacggattcatcaatagacaattaaccctaactaatcaaagtgttaaagcagtttgcgatatactcaaaatgactgaaaaaggttcagaaattgtatattcaaaagccaattttgtatcagactttagaaaattatgtggtgaactaagaccaagctatgatgcattcgtaaaggtccgcgatataaatgattttcaccacgccaatgatgcttacttaaacatcgttgttggcaacgtatactatgaaaagtttaaaaacttttatattaacaatagaatcgattacgacaataatgggaaaaaggacttgagcgtactagcatcaaaattattcacgaaaacacaagcagatgacaaaacaggtaatatatactgggaagcaaggttccacaacgaaaaagaaaccgactcgaatggtaaagagaggacgatcaaagtcagagatgagggtactgaaagcacctttgataagatagagtactacatggaactgaacgatcctctcgtgacacaaatgcaatatacacttagtggaaaacaggggttctttaagaaaataactcttaaaacaaaagcaaaagataatgaagataattcagataaactattccctttaaaacaatatttaaggtcagactcaaacaaggtaatggatgtaaataaatacggaggatattctgatatgattaccccttactttatgctagttcaaagcgaaggcaagaaaggtaaacatatatatagcctagaatcaataccaacaatctaccttaagagctttaagaaaaaggaagaagacataatcaattatttaagctgtaaaaacaaattaaagaatcccgtagttataagtgacaaactactgatgagaaccatagttaaaattccatactttaaaaatgattcaaacctatcattagtaaaactcggaacgtcaggaagaacaggaaataacatcatatacataaatttatcagaactaatattgccaatagaatggaaaaactactatcgcaaaatctcaaacctattaggcactaacgtgagctcaacaaaaccaaaagatctaagtaaatttacagaacaaatgaaaaacgatccaactagcactctggtagacgggagtaataaagtagaacatgacaaaaacaacagattctttagttacctaataaacaacgtaattaataaacccatatttgaaggattacctaagacatcctgttcattcatcaaactggaatcaaagtacgacgaattttgctcgttaaatactttagaacaagccaagatcattgcaacgataataaaacttttatcatgtaaatcagtgcaaggatgcaagttaagtaatttatcaggattaccttcatcgttaggagcacttatcagtaacaaagcgctaacggaaggaacaatcatatccaaagagtcgagctgtggtctaaaagaaaacattatattcgtagtgccaaacgactga

SEQ ID NO: 9257 - RNA, 5067 nt, synthetic construct
  misc_feature 1..5067: note = Cas9 variant
  source 1..5067: mol_type = other RNA
atggaatttaaaaaagtattaggattagacatagggacaaacagtatagggtgcgccctactctcattacctaaatcaatccaagattacggaaaaggtggacgattggaatggctaactagcagggttataccactagatgcggattacatgaaagctttcatagatggaaaaaacggcttgccgcaagtgataaccccggcaggcaagcgaagacaaaaacgcggaagtagaagactaaagcatcgatacaaattaagaagatctagattaataagggtctttaaaacactaaattggttaccagaagactttcctctggataatccaaaacgaataaaagaaacaataagcacagaagggaaatttagcttccgaatatcagactacgtcccaattagcgatgaatcatacagagaattctacagagagttcggatacccagaaaacgaaatagagcaagtcatagaagagataaacttccgaagaaaaaccaaaggaaaaaacaagaacccaatgataaaattattgccagaagactgggtagtttattacctcagaaaaaaagcattaataaaaccaacaacaaaagaagaactcataaggattatatacctatttaaccagaggagggggtttaaatcttcccgcaaagaccttacggaaacagcaatccttgattacgatgaattcgcgaaacgcttagcagaaaaagaaaagtactctgcggaaaattacgagacaaaattcgtgtctatcacaaaagtaaaagaagtagtagaactaaaaacagatgggagaaaaggtaaaaaacggttcaaagtaatcttggaagactctaggatcgaaccttacgaaatagaacgaaaagaaaagcctgattgggaaggaaaagaatacacttttctagttacccaaaaactagagaaaggcaaatttaaacagaataagcctgacctacccaaagaagaggactgggcactgtgcacaacagcactcgacaacagaatgggaagcaaacacccgggtgaatttttcttcgatgaattattaaaagcatttaaggaaaaaagaggatataaaataagacagtatccagtaaaccgatggcgatacaagaaagaactagaattcatatggaccaaacaatgccaactgaacccagaactcaataacctaaacataaacaaagaaatattaagaaaactagcaacagtcctgtacccttctcaatcgaaattctttggccctaaaataaaagaattcgaaaactctgatgtactacatataatatcggaggacattatatattaccaaagagacttaaaatcacaaaagtcgctcatttcagaatgtagatacgaaaaaagaaagggcatagacggagagatatatggactaaaatgcataccaaaaagtagtccgttatatcaagaatttagaatatggcaagacatccataacataaaagtgataagaaaagaaagcgaggtcaacggaaaaaagaagattaacatagacgaaacacaattatatatcaatgaaaacattaaagaaaaactattcgaactatttaacagtaaagactcattaagcgaaaaagatatattagaattaatctcattaaacattataaacagtggaattaaaatatcaaaaaaggaagaggaaacgactcatcgaatcaacctcttcgcaaatcgtaaagaacttaaaggtaatgagacgaagagcagatatagaaaagtcttcaaaaaattagggttcgacggagagtatattttaaatcatcctagcaaattaaataggctatggcattcagactattcaaatgactacgcagacaaagaaaaaactgaaaaatcaatattaagctcgctgggttggaaaaacagaaacgggaaatgggaaaaaagcaagaactacgacgtatttaatttaccattggaagtagctaaggcgatagctaacctcccaccactaaaaaaagagtatggatcatacagcgccttggcaatacgaaaaatgttggttgtaatgagggatggaaaatactggcaacatcccgaccaaatcgcaaaagaccaagagaacacgagcttaatgttattcgacaaaaacctcatacaattaaccaacaatcaacgaaaagtcttaaacaaatacttactaaccctagcggaagttcaaaaaaggagcacactcataaaacagaaattaaatgaaatcgaacataatccgtataaactggaactcgtgagtgaccaggacttggaaaaacaggttctaaaatcattccttgaaaaaaagaatgaatcagattacttgaaaggattaaagacataccaagcagggtatctaatctacgggaaacacagtgaaaaagacgtaccgattgtaaattcccccgatgaactcggagaatatataagaaaaaaattacccaacaattctctcagaaacccaattgtagaacaagtaatacgcgaaaccatattcatcgtgagagacgtatggaaatctttcggtatcatagacgaaatacacatagaactcggacgagagttaaaaaacaattctgaagaaagaaaaaaaacgagtgaaagccaagaaaaaaatttccaagaaaaggaacgcgccaggaaactgctcaaagaacttctaaatagtagcaactttgaacactacgacgaaaacggaaacaaaatcttttcaagttttacagtgaacccaaatcctgacagcccactggatatagagaaatttcgtatatggaaaaatcaatcaggtctcacagacgaagaattaaataaaaaactaaaagacgaaaaaatacccacagaaatcgaagtaaaaaaatatatcttatggttgacgcaaaaatgccgaagcccatatactggaaaaattatccctctatcgaaactcttcgactcaaatgtctatgaaatagaacacatcatacctagatcaaaaatgaagaacgacagcaccaacaatcttgtgatatgtgaactaggtgttaacaaagcaaaaggagatagactagcagcaaattttatatcagaaagtaatggcaaatgcaagttcggagaggtcgaatacacgctactaaaatacggagactatcttcagtactgtaaggatacgttcaaatatcaaaaagcaaaatataaaaacttactggcaaccgaaccaccagaagacttcatcgagcgacaaataaatgatacacgttacataggaagaaaactagcagaactcctaactcccgtcgtcaaagattccaagaatataatcttcactattggatcaatcacatcagaactcaaaataacatggggactaaacggtgtttggaaagacatactacgaccaagatttaaaaggctcgaatcaataataaataaaaaattaatattccaagacgaagacgatccaaacaaataccacttcgacctatctatcaacccacaattagacaaagaagggctaaaacgattagatcacagacatcacgcacttgatgcaacaattattgccgccacaacgcgagaacacgtacgatacctcaatagcttaaatgcagcggataatgacgaagaaaaaagagaatactttttgagtttgtgtaaccacaaaatcagagattttaaattaccgtgggagaatttcacctcagaagttaaaagtaaactattaagttgcgttgtaagctataaggaatcaaaaccaattctgtcagatccatttaacaagtatctgaaatgggaatataagaacggaaaatggcaaaaagtttttgcaatacaaataaaaaatgacagatggaaagcagtgcgtaggagcatgtttaaagaaccaattggaacagtatggataaaaaaaataaaggaggtttccttgaaagaagccataaaaatacaagccatatgggaagaagtaaaaaacgatccagtacgtaaaaaaaaagaaaaatacatatatgatgattacgcacaaaaggttatagctaaaattgtgcaagagttgggtctttcaagcagcatgagaaaacaagatgacgaaaaactaaataaatttattaacgaggccaaggtctctgcgggcgttaacaagaatcttaatacgacaaataagacgatatataacctggaaggtcgattttatgaaaaaatcaaagtcgccgaatacgttttatataaagcgaagagaatgccactcaacaaaaaagaatacatagaaaagctatcactgcaaaagatgttcaacgaccttcccaatttcatactggaaaaaagcatactggacaactacccagaaatacttaaggagctcgaatcggataataaatacatcatagaaccacacaagaaaaataatcctgtaaacagacttttactagaacacattttggaatatcataataaccccaaagaggcatttagtactgaaggcctagaaaaactcaacaaaaaagcaatcaataaaattggaaaacccattaaatacataacacgactcgatggtgacataaatgaagaagaaatatttcgaggggcggttttcgagacagacaaaggaagcaacgtttattttgttatgtatgaaaataaccaaaccaaggaccgcgaatttcttaagccaaatccaagcataagcgtacttaaagcaatagaacataaaaacaagatagattttttcgcaccaaaccgattaggattttccagaataattctttccccaggagacttagtttacgtaccaactaatgatcaatacgtactcataaaagacaattcatccaatgaaacgattatcaattgggacgacaatgaattcatttcaaatcgcatttaccaagtaaaaaaattcacgggaaattcttgttacttcttaaaaaatgatatcgccagcctgattctatcctacagcgcatcaaacggagtcggagaatttggaagtcaaaacattagtgaatactcagtagacgacccccccattcgaataaaagatgtttgcataaaaattcgcgtagacagactcggcaatgtcaggcctctatga

SEQ ID NO: 9258 - RNA, 3924 nt, synthetic construct
  misc_feature 1..3924: note = Cpf1 variant
  source 1..3924: mol_type = other RNA
atgactcaattcgaaggattcactaatttatatcaggttagcaaaacgttaagattcgaattaattccccaaggaaaaacactaaaacatatccaagaacaaggattcatcgaagaagataaagcaaggaacgatcactacaaagaactcaaacccataatagatcgaatatacaaaacctatgccgatcagtgcctccaacttgtccaactagactgggaaaatctatctgccgcaatagacagctacagaaaggagaaaaccgaagagacacgaaatgcccttatagaagaacaagccacttatcgaaacgcgatacacgactactttataggaaggacagacaacttaacggatgccatcaataaacggcacgcagaaatttataaaggattattcaaagctgaattattcaatggaaaagtactaaaacaattaggcacagtcacaactaccgaacacgaaaatgccctgcttagatcgttcgataaattcactacatatttcagcggcttttatgaaaatagaaagaatgtattttcagcagaggacatatcaacagcaatcccccatagaatcgtccaagacaatttccccaaattcaaagaaaactgtcacatatttacccgattaattactgccgtccctagtctaagagaacacttcgaaaatgtgaagaaagctataggtatattcgtttcaacttcgatagaagaagtttttagttttccattctacaatcaattactcacccaaacacagatagacctatacaatcaactactaggtggaatatcacgcgaagctggaactgaaaagataaaagggcttaatgaagtactaaacttggccatacagaaaaacgatgaaactgcccacataatagcgagcttaccccacagatttataccattattcaaacaaatcttatcagaccgcaataccttaagttttatactagaagagttcaaatcagacgaagaagtaatacaatcattctgcaaatacaaaacactcctccgaaatgaaaatgtgctagaaacagcagaagcactattcaatgaactaaattcaattgatctgacccacattttcatctcacacaagaaattagaaacaatttccagcgccctatgtgatcactgggatacgctaaggaatgccctatacgaaagaagaataagtgaacttacaggcaaaatcactaaatcagcaaaagaaaaagtacaaagatctcttaaacacgaagacataaaccttcaagaaattatctccgcagcgggaaaagaactgtcagaggcttttaaacagaaaacctccgaaatattaagccatgcacacgctgcactagaccaacccttaccaacaactcttaagaaacaagaagaaaaagaaatcttaaaatcgcaactagatagcctcttaggcttataccatctactagattggttcgcagtcgatgaaagcaacgaagtagatcctgaattttcagcaagactgacaggaattaaattagaaatggaaccatccctatcattttataacaaagccaggaattatgcgacaaagaaaccatactccgttgaaaaatttaaactaaatttccaaatgccaactttagcaagtggatgggatgtaaacaaagagaaaaataacggtgctatcctatttgttaaaaacggtctatattatttaggaataatgccaaaacaaaaaggtagatataaagctctatcattcgaacccaccgagaaaacctctgaaggtttcgataaaatgtactatgactacttcccagatgcagcaaaaatgattccaaaatgttcgacacaacttaaagctgtaaccgcacacttccaaactcatactactcccatattattaagcaataattttatcgaacccctagaaattacgaaagaaatatacgatctcaataacccagaaaaagaacctaagaaattccaaacagcgtatgcaaagaaaacaggtgatcaaaaaggataccgagaagctctttgtaaatggattgatttcacaagagattttctaagtaaatacaccaaaactacatctatagatttatccagtctacgtccctcttcacagtataaagacttaggagaatattacgccgaactaaacccactactataccacatatcattccaaagaatagcagaaaaagaaataatggatgcagtagaaactggaaaactctatctatttcaaatatataataaagactttgcgaaaggccatcatggaaaaccaaatctacacacattatactggactggcctattctcaccagaaaacctagctaaaaccagcataaaactcaatggacaagcagaactcttctacagacccaaatctcgaatgaaaagaatggctcacagactaggagagaaaatgctaaacaagaaactaaaagaccagaaaaccccaatcccagacacattatatcaagaattatacgactatgttaaccacagattgtcgcatgatttaagtgatgaagctcgcgcactattacccaacgtgataactaaagaagtctcacacgaaataataaaagatcgacgtttcactagcgataaattcttctttcatgttccaataacattaaattatcaagcagccaattccccctcaaaatttaaccaaagagtaaatgcatacctcaaagaacacccagaaacacccataatcggaattgatagaggagaaagaaatctaatctacataaccgtgatagacagtaccgggaaaattctcgaacaaagatcccttaacacaatccaacaatttgactatcagaagaaactagataatcgcgaaaaagaacgagttgcagctagacaagcatggtcagttgtaggaactataaaagacctaaaacaaggatatctatctcaagtaatccatgaaatcgtagacttaatgattcattaccaagcagtcgtagtactcgaaaaccttaactttggatttaaatcaaaaaggactggaatcgctgaaaaagcagtctaccaacaatttgagaaaatgcttattgataaactcaactgtctcgtattaaaagactacccagcagaaaaagtaggaggcgtcttaaacccctatcaactaacagaccaatttacctctttcgccaaaatgggaacacaatcaggcttccttttctatgttccagccccgtatacatccaaaatagaccctttaactggattcgtcgacccattcgtatggaaaacaatcaaaaatcatgaatcacgaaaacatttcctagaaggcttcgacttccttcattatgatgtgaagacgggtgacttcatactacactttaaaatgaatagaaacctctcatttcaacgtggtttaccaggttttatgccagcatgggatatagtattcgagaaaaatgaaacacaattcgacgctaaaggtacaccgttcatagcaggcaaacgtatagttccagtcatagaaaatcaccgtttcacaggtagatatcgcgatctatatccggcaaacgaattaatagccctgttagaagaaaaagggatagtatttagagatggtagtaatatactaccgaaactcttagaaaatgacgactcacacgcgatagatacaatggttgcactaattcgttcagtccttcaaatgcgaaactctaacgcagccacgggagaagactacataaattccccagttcgagatcttaacggtgtatgtttcgattcaagatttcaaaatccagaatggcccatggacgctgacgcgaacggggcatatcatattgcattaaaaggacaactccttctaaaccacctaaaagaatctaaagacctaaaattgcaaaacgggatctcaaaccaagactggctagcctatatacaggaactaagaaactga

SEQ ID NO: 9259 - RNA, 3903 nt, synthetic construct
  misc_feature 1..3903: note = Cpf1 variant
  source 1..3903: mol_type = other RNA
atgtcaatataccaagagttcgtaaacaaatatagtctaagcaaaacactcagatttgaactaataccgcaaggaaaaaccttagaaaatataaaagcacgaggactaatactagacgacgaaaaacgcgcaaaagactacaagaaagcaaaacaaatcatcgacaaataccatcaattctttatagaagaaatactatcaagcgtatgcatatcagaagatctactccaaaattacagtgatgtctattttaaacttaagaaatctgacgatgataatctacaaaaagactttaaatccgctaaagacacaatcaagaaacaaatatccgaatacataaaagacagcgaaaaatttaaaaatctctttaaccaaaacctaatagacgctaagaaaggtcaagaatccgatctaattctatggctaaaacaatctaaagacaacggtatagaactttttaaagcaaattcagatataacagatattgatgaagcgctagaaataataaaatcatttaaaggatggacaacatacttcaaaggcttccatgaaaatcgcaaaaatgtatactcaagcaatgacataccaacatctataatttatcgaatagtagacgataacctccctaaatttctcgaaaacaaagctaaatacgaaagtcttaaagataaagcccccgaagcaatcaactacgaacaaattaagaaagacctagcagaagaacttacatttgacatagattacaaaacatcagaagtaaaccaaagagtcttttcattggatgaagttttcgaaatagcaaactttaacaattacctgaatcaaagtggtatcacaaaatttaatactatcataggtggtaaatttgttaatggcgaaaacacaaaacgaaaaggtataaacgaatacataaacctatactctcaacaaataaacgataaaacactaaagaaatataaaatgagtgtgctatttaaacagattctatccgacacagaatcaaaatccttcgtaattgacaaactcgaggatgacagcgacgtagtaacaactatgcaaagtttttacgaacaaatagcagctttcaagacagtagaagagaaatccataaaagagacgctcagcttattatttgacgatttaaaagcgcaaaaattagaccttagcaaaatttattttaagaacgataaaagtttaaccgatttatctcaacaagtatttgacgactattctgtaataggcaccgccgttctagaatacattacacaacaaattgccccaaagaatctagataacccatctaagaaagaacaagaactaatcgcaaagaaaacagaaaaagcaaaatatctatccctagaaacaatcaaactcgcgctagaagaatttaataaacatcgagacatcgataaacaatgtagattcgaagaaatcctcgcgaacttcgcagcaatcccaatgatcttcgacgaaatcgcacagaacaaagacaacttagcacaaatttcgatcaaataccaaaatcaaggaaagaaagacctccttcaggcttctgccgaagatgacgtaaaagcaataaaagacctcctagatcaaacaaataacctattacacaaactcaaaatatttcacataagtcaatcagaggataaagcaaacattcttgataaagacgaacacttctacttagtatttgaagaatgttacttcgaacttgcaaacatagtaccactctacaacaagatacgtaactatatcacacaaaaaccatacagcgacgaaaaattcaaactaaatttcgaaaattcaacgctagcaaacggatgggacaagaataaagaacctgataacacagcaatactattcataaaagacgacaaatattaccttggagtaatgaacaagaaaaacaacaaaatattcgacgataaagcaataaaagaaaacaaaggagaagggtacaagaaaatagtatataaactactgccaggtgctaataaaatgcttccaaaggtcttctttagtgcgaaatctattaaattttataacccatccgaagatattttaagaatacgaaaccattcaacacataccaaaaatgggtcaccacaaaagggatacgaaaagtttgagttcaacatagaagactgtcgaaaattcatagacttctataagcaatcgatctccaaacatccagaatggaaggattttggatttagattctctgacacccaaagatataactcaatagacgagttctatagagaagtcgaaaaccaaggatataaattaaccttcgagaacatatcagaatcctacatcgattctgtagtaaatcaagggaaactctacttattccaaatatacaataaagacttttcagcatactccaagggacgaccaaaccttcatacattatactggaaagctcttttcgacgaaagaaacctccaagacgtcgtatacaagttaaacggagaagcggaactattctatagaaaacaaagcataccaaagaaaataacacatccagctaaagaggctatcgccaataaaaataaagataaccccaagaaagaatcagtttttgaatatgacttaattaaagacaaaagattcactgaagacaaatttttcttccattgtccaataacaatcaatttcaaaagctcaggagccaataaatttaacgacgaaattaatctactactcaaagaaaaagctaacgatgttcatattctatccatagatcgaggagaacgtcacttagcctactataccctagtagatggaaaaggaaacataataaaacaagatacatttaacataattggaaacgatcgaatgaaaacaaattaccacgacaaattagcagcaatcgaaaaagaccgcgactccgcaagaaaagactggaagaaaatcaacaacatcaaagaaatgaaagaaggctacctttcacaagtcgttcacgaaatagctaaattagtaatagaatataatgcaatagtagtatttgaagatctaaacttcggattcaaacgtggacgcttcaaagtcgaaaaacaagtataccaaaaattagagaaaatgttgatcgaaaaactaaactacctagttttcaaagataatgaatttgacaaaacaggtggagtgctcagagcctaccaactaacagcaccattcgaaacgttcaagaaaatgggaaaacaaactggcataatatattacgtaccagcaggattcacatcaaaaatttgccctgtaaccggctttgttaaccaactatatcccaaatatgaatcggtcagcaaaagtcaagaatttttctcaaaatttgacaaaatttgttataatctcgacaaaggatattttgaatttagcttcgactataaaaacttcggcgataaagcagccaaaggaaaatggacgattgccagttttggatcacggctaatcaatttcagaaattctgacaaaaaccacaactgggataccagagaagtatatcccaccaaagaattagaaaaactactaaaagactattcgatcgaatatggacacggagaatgcataaaagccgctatatgcggtgaaagcgacaagaaattcttcgcaaaactaacatcagtattaaacactatattgcaaatgcgaaactcaaaaacaggtaccgaactagactacctaatctcccctgtagcagacgtaaacggtaatttctttgactcaaggcaggcacccaaaaacatgccacaagatgccgatgcaaatggagcttatcacataggcctaaaaggactaatgttgctaggaagaattaaaaacaaccaggaagggaagaaattaaatctcgttattaaaaacgaagaatactttgaatttgtacaaaacagaaacaactga

SEQ ID NO: 9260 - RNA, 1341 nt, synthetic construct
  misc_feature 1..1341: note = Cpf1 variant
  source 1..1341: mol_type = other RNA
atgaaacctgacataaaagacagagaatatatgtatcgattaataataggacaattattctatgatggacaccaacaaatagccgtcaatttagctaacacattaggctgcagcgcgccaccacccccaccaagcgataaactattcaggctagtaactattgcaaaacaatttgtagaagaccccgactataaagctgaagaaaacacaatgccaatgcaattcgaaacatcttctgcaggactagacctccaatatgacgctgacgtggcagcaacatcaccagaaccatcacaatacgaaacaatatatttaacagtacataaagcaccatgccgagctgcagcattcaactcagacggatctctaatagcaacaggatcagcagattgttcaataaaaatcatggacgtagaaagaatactagcacgtgaaaaagaacatagagaaatgaacgaaaacggaccagacgcacaccatccagtaataagaacattatacgaccacgtagacgtacgacgcgacttcggaagattttcagacaaaatactcgatttccaagacgtaaatacagtaatattccatccaagagatgcaatcctaatcagcggatcaaatgacaaaacagtaaaactattcgatttctccaaaaccgccgtcaaaagagccatgaaaacattatccgaagtatacccagtaagagcactaagctgtcatcccggaggagaatttttattagtagcaacagatcatccaacagtaagattatacaatatcgaaaccgcacaagcatacgcatcagcaaaccctgacgatcaacacagagaatcagttacagacgtacactactcagaaaacgctagactatatgtaacagcgtcaaaagacggagacgtaaaagtatgggacggagtatcaagcagatgcgtagaaacattcaaaagagcacacgacggatcctcaatctgcagtgccaaattcactaaaaatggaaaatatatattaacatcaggaatggactcaatagtaaaattatgggaactatccacaaacagatgtttaatagtatatacaggagcaggagctaccggagcacaagactatccaacatcagcatcattcaatcaaaacgaagatttcgtcttattcccagacgaaaaatcaggaagtatgtgttcatgggaagctagaaatgcagacagaaaacgcttattagcactcggacacacatcagcatgtagaaccttcgttcactcaccatcaatgccagcatttatgacaggaagcgatgatcatagagcaagattttggtacagaaaacctacaactaacgacaactga

SEQ ID NO: 9261 - RNA, 1293 nt, synthetic construct
  misc_feature 1..1293: note = Cpf1 variant
  source 1..1293: mol_type = other RNA
atgaaacccgacataaaagacagagaatatatgtatagactaataataggacaactattttacgacggacatcaacaaatcgccgtcacactagcaaatacactaggctgttcagcaccagcaccaccaccatcagataaattatatcgattagtaacaatagccaaacaattcgtcgaagacccagattataaagcagaagaaaaatctctaccaatgcaatttgaaacagtctcaacaggcttagatttagaatatgacgctgacgtacaaccagtatcaccagaaccatcacaatacgaaacaatatacctaacagtacataaagcaccatgcagagctgccgcattcaactcagacggatctttagtagccacaggatccgcagattgctcaattaaaataatggacgttgaaagaatattagcaagagaaaaagaacatagagaaatgaacgaaaacggaccagacgcacaccatccagttataaggacattatacgatcacgtagacgatgtaaatacagtactatttcacccaagagatgccatactaatatcaggaagtaatgataaaacagttaaactattcgatttctcaaaaacagcagtaaaaagagcaatgaaaaccttatcagaagtatacccagtaagagcattaagctgtcacccaggaggagaatttttactcgtagcaaccgatcacccaactgtaagattatacaatatagaaacagcccaagcatacgctagcgcaaatcctgacgatcaacatagagaatcagtcacagatgtacactactcagaaaacgccagactatatgtaacagcatcaaaagatggagatgtaaagatatgggacggagtatcaaaccgatgtgtagaaacatttaaaagagcacacgacggatcagcaatatgctcagcaaaatttaccaaaaacggcaaatatttactaacatcaggaatggactcaatagtaaaattatgggaactatcaacaaatagatgtttaatagtatacacaggagcaggcgcaacaggagcacaagactacgccacaagcgcatcatttaatcacaatgaagactacgtactattcccagacgaaaaatccggatctatgtgtagttgggatgcccgaaattcagatagaaaaagactactagcattaggacacacatcagcatgtagaacattcgtacatagccctagcatgccagcatttatgacaggctcagatgaccatagagcccgtttttggtaccgaaaacccgcaacaactgacaattga

SEQ ID NO: 9262 - RNA, 3690 nt, synthetic construct
  misc_feature 1..3690: note = Cpf1 variant
  source 1..3690: mol_type = other RNA
atggccgcgtcgaaactagaaaagtttacgaactgttattccctaagtaaaacgttgagatttaaagcaataccagtagggaaaacacaggaaaatatagataataaacgtctactcgtagaagacgaaaaaagagctgaagactataaaggagtaaaaaaactactagatcgatactacttatcattcataaatgatgtcctacattctataaaattaaaaaatctaaataactacataagtttatttaggaaaaagacaagaaccgaaaaagaaaataaagaattagaaaacttggaaataaatttacgaaaagaaattgcaaaagcctttaaaggagcagcaggttacaaatcgctatttaaaaaggacataattgaaacaatactacctgaagcggcagacgataaagacgaaatagcactagtaaatagtttcaatggattcacaacagcatttaccggattctttgacaacagagaaaacatgttttcagaagaagccaaatcaaccagtatagcattcaggtgtataaacgaaaacctaacaagatacattagtaatatggatatattcgaaaaagtcgatgcaatattcgacaaacatgaagtacaagaaataaaagaaaaaatactgaacagtgactatgacgtagaagacttcttcgaaggagagttcttcaactttgtattaacacaagaaggaatagacgtatacaacgcaattatcggtggctttgtaacagaaagcggtgaaaaaattaaaggactaaatgaatacattaacctttacaacgcaaaaacaaaacaagcgctgccaaaattcaagcccttatataaacaagtactaagtgaccgtgaaagtctatcattctacggagaaggatacacatcagatgaagaagtattagaagtattccgaaatacactcaacaaaaatagcgaaatattcagctcgataaaaaaattagaaaaattattcaaaaactttgacgagtactcctccgctgggatattcgtaaaaaatggcccagcaataagtaccataagcaaagacatattcggggaatggaacctaataagagacaaatggaatgcagaatatgatgatatacatcttaaaaaaaaagcagtagtcacagaaaaatatgaagatgaccgaagaaaatctttcaagaagatagggagcttttcactagaacagcttcaagaatacgcagacgccgacctatcagtagttgaaaaattaaaagaaataataattcaaaaagtcgatgaaatatataaagtgtatggatccagtgaaaaactattcgatgctgatttcgtactagaaaaatcgctcaaaaaaaatgacgcagttgttgcgataatgaaagacttactcgattctgttaaatccttcgaaaactacataaaagcattctttggagaaggcaaagaaactaacagagacgaatccttctacggagactttgtcttagcctatgatatactacttaaagttgaccacatctacgacgccattagaaactatgttacacaaaaaccttattcaaaagacaaattcaaactatatttccaaaaccctcagttcatgggaggatgggacaaagacaaagaaacagactatcgtgctaccattttaagatatggaagtaagtattaccttgctataatggataaaaaatatgcgaaatgcttacaaaaaatcgacaaagacgacgtaaacgggaattacgaaaaaataaactacaagttactaccaggaccaaataaaatgttaccaaaagtttttttcagcaagaaatggatggcatactacaatccgagcgaagacatacaaaaaatatacaaaaacggcacattcaaaaaaggagacatgtttaatttaaacgattgccacaaattaatcgattttttcaaagactcaatctcaagataccctaaatggagtaacgcatacgactttaacttttccgaaaccgaaaaatacaaagacattgcaggcttctacagagaagtagaagaacaaggatacaaagtatcttttgaatctgcgagtaaaaaagaagtagacaaactcgttgaagaaggaaaactatacatgtttcagatctacaataaagattttagcgacaaaagccacggtacacctaatctccacacaatgtacttcaaactattattcgatgaaaacaaccacgggcaaataagacttagcgggggagctgaactctttatgcgaagagcatccttaaagaaagaggaactagtagtacaccctgcaaactcgccaattgcaaacaaaaacccggacaaccccaaaaaaacaactaccttatcctatgatgtgtacaaagacaaaaggttttcagaggaccagtacgagctacatataccaatcgcaataaataaatgcccaaaaaatatattcaaaattaacaccgaagtaagagtactactcaaacatgacgacaacccttacgtcataggaatagatcgaggggaaagaaatttgctttatatagtagtcgtagatggaaaaggcaacatagtcgaacaatatagtttaaatgaaataataaataacttcaacggaataagaataaagaccgactaccatagtttactagataagaaagaaaaggaaagattcgaagctcggcaaaattggacctcgatcgaaaacatcaaagaactaaaagcgggatatatatcacaagtagtgcacaaaatctgcgaactagtcgaaaaatatgatgcagtaattgcactcgaagacctaaactccggattcaaaaattcaagagtaaaagtagaaaaacaagtctaccaaaaattcgaaaaaatgctaatcgacaaattaaactacatggttgataagaaatctaacccatgcgctaccggaggagctctcaaagggtatcaaataacaaacaaattcgagagttttaaaagtatgagtacgcaaaatggattcatattctacatacctgcatggctaacgtcaaaaatagatccaagcacgggcttcgtcaacctacttaaaacaaaatatacatccatagcagattccaaaaaattcatctcaagctttgacagaataatgtatgtcccagaagaagatctatttgagttcgccttagactacaaaaatttcagtagaacagacgctgactatataaaaaaatggaaactctactcatacggaaaccgtattcgcatattcgcagctgcaaaaaagaataatgtattcgcctgggaggaagtgtgcctaacatctgcatataaggaactattcaacaaatatgggataaactatcaacagggcgacataagggccttgctttgtgagcaaagcgataaagcattctactcttcattcatggcacttatgtccttaatgttacaaatgagaaattctataaccggacgtacagacgtcgactttctaatctcgcctgtaaaaaactcagatggaatattctacgactccaggaattacgaagcacaagaaaacgccattctgccaaaaaacgccgatgccaacggggcatataacatagcaagaaaagtactgtgggcaatcggacaatttaagaaagcagaggacgaaaagctggataaagtcaaaatagccatcagcaataaagaatggctcgaatacgcacaaacctcagtcaagtga

SEQ ID NO: 9263 - RNA, 3903 nt, synthetic construct
  misc_feature 1..3903: note = Cpf1 variant
  source 1..3903: mol_type = other RNA
atgtcaatataccaagagttcgtaaacaaatactccctttcaaaaacattacgatttgaattgatacctcaaggaaaaaccctcgaaaatataaaagcacgaggactaattctagatgatgaaaaacgagcaaaagactataagaaagccaaacaaattatagataaataccatcaattctttatagaagaaattctttcatcagtatgcatatcagaagacctactacaaaactacagcgatgtctacttcaaacttaagaaatccgacgacgacaacttacaaaaagattttaaaagcgcaaaagatacaatcaagaaacagatttctgaatacataaaagacagcgaaaaatttaaaaatctctttaaccaaaaccttatcgacgccaagaaaggacaagagtccgatttaatactatggctgaaacaatcaaaagacaacggaatagaactctttaaagcaaattctgatattaccgatatagacgaagcccttgaaataattaaatccttcaaaggttggacaacatactttaaaggatttcatgaaaatcgcaaaaatgtatatagtagtgatgacataccaaccagcattatatatagaatagtcgacgataacctcccaaaattcctagaaaataaagctaaatatgagagcttaaaagacaaagcaccagaagcgataaactacgaacaaatcaagaaagatttagcagaagaactcactttcgacattgactataaaacatcagaagtaaatcaaagagtatttagtttagacgaagtgttcgaaattgcaaactttaacaattatttaaatcaaagcggaattacaaaatttaatacaattataggaggaaaatttgtaaatggtgaaaacacaaaacgtaaaggaataaacgaatatataaacctttattcacaacaaattaacgataaaacccttaagaaatacaaaatgtcagtcctcttcaaacaaatacttagcgacaccgaatccaaatcattcgttattgataaactcgaagatgattcagacgtcgttaccacaatgcagagcttttatgaacaaatagcagcattcaaaaccgtagaagaaaaatcaataaaagaaaccctctctttactattcgacgaccttaaagcacagaaactagacctatcaaagatatatttcaaaaacgacaaatcactaaccgatctatcccaacaagtcttcgacgactactccgtgataggaacagcagtcttggaatacataactcaacaagtagctccgaaaaatttagacaatccatctaagaaagaacaggacctaatagccaagaaaactgaaaaagcaaaatacctttccttagaaacaatcaaactagcactagaagaatttaataaacatcgagatatcgataaacaatgccgttttgaagaaatattagcaaattttgcagcaataccaatgatattcgatgaaatcgcccaaaacaaagataatctagcccaaatatccttaaaatatcaaaatcaaggcaagaaagatttattacaagcaagcgcagaagaagatgtaaaagcaatcaaagatctcttagaccaaactaacaatctcctacaccgtctaaaaatctttcacatatcccaaagtgaagacaaagcaaatatactagacaaagatgagcacttttacctagtctttgaagaatgctattttgaactagctaatatagtcccattatataataaaatccggaactacataacacaaaaaccatattctgatgaaaaatttaaactgaattttgaaaatagtacgttggcaaacggatgggataaaaacaaagaaccagacaatacagcgatattatttatcaaagatgacaaatactacctcggagtcatgaacaagaaaaataataaaatctttgatgataaagcgatcaaagaaaacaaaggggaaggatacaagaaaatagtctataaattactccccggagcaaacaaaatgcttccaaaagtattcttttccgcaaaatccatcaaattttacaacccctcagaggacattcttagaataagaaatcactctacacatacgaaaaatgggaatcctcaaaaaggatatgaaaaatttgaatttaacatagaagactgccgcaaattcatcgatttctataaagaatctatatctaaacatccagaatggaaagatttcggatttcgtttctcagatacacaacgatacaattcaatagacgaattttatcgcgaagtagaaaatcaaggatacaaattaacattcgaaaacatatctgaatcatacatagactcagtagtaaaccaagggaaattatatttgttccaaatatacaataaagactttagtgcttattcaaaaggacgaccaaatctccatactttatactggaaagcacttttcgacgaaagaaacctacaggacgttgtttataaattaaatggagaagcagaattattttaccgaaaacaatccatacccaagaaaataacccatcccgccaaagaagccatagctaacaaaaacaaagataatcccaagaaagaatcagttttcgaatatgatctaattaaagacaaacgatttacggaggacaaattcttctttcactgcccaatcacaatcaactttaaatcatcaggggcaaataaatttaacgacgaaataaatctcctcttaaaagagaaagctaacgacgtgcacatcttatcaatcgatcgaggtgaaagacacctagcttattacacactcgtagatggaaaaggaaatataataaaacaagacacatttaacataataggaaacgatcgtatgaaaacaaactatcatgataaactcgcagccatagaaaaagaccgggattctgcacgcaaagactggaagaaaataaacaacataaaagagatgaaagaaggatatctgagtcaagtagtacatgaaatagcaaaactggttatagaacacaatgcaatcgttgtattcgaagatctaaactttggattcaaaagaggcagatttaaagttgaaaaacaagtttaccaaaaactagagaaaatgttgatagagaaactgaattacctcgtatttaaagacaacgagttcgacaaaacaggtggtgtactacgtgcataccaattaaccgcaccttttgaaacgtttaaaaagatgggaaaacaaacaggaattatatactacgtacccgctggttttacatcaaaaatatgcccagtaacaggcttcgttaatcaactgtatccaaaatatgaatcagtatcaaaatcgcaagaatttttctcaaaattcgataagatctgctacaatttagacaaaggatatttcgagttctcattcgattacaaaaacttcggcgataaagccgccaaaggaaaatggacaatcgctagtttcggatcaagactaataaacttccgcaacagcgataaaaatcataactgggatacaagagaagtctacccaaccaaagagctcgaaaaattactcaaagattactcaatagaatacggacatggcgaatgtataaaagcagccatatgcggagaatcagacaaaaagttcttcgcaaaactaacgtctgtcttaaatacgatacttcagatgagaaattcaaaaacagggactgaactagactacctcatcagtcccgtcgctgatgtaaacggtaactttttcgactcccgacaagcacccaaaaacatgcctcaggatgctgacgcaaacggtgcctatcacataggcctaaagggattaatgctactagatagaatcaaaaataatcaagaaggcaagaaactaaatttagtaatcaagaatgaagaatacttcgagttcgttcaaaacaggaacaattga

SEQ ID NO: 9264 - RNA, 1071 nt, synthetic construct
  misc_feature 1..1071: note = Cpf1 variant
  source 1..1071: mol_type = other RNA
atgaaaaccaattaccacgacaaactagcagcaatagaaaaagatagagaaagtgcaagaaaagactggaaaaaaataaacaacataaaagaaatgaaagaaggttacctaagccaagtagtacacgaaatagcaaaactagtaataggatacaacgctatagtagttttcgaagatctcaacttcggattcaaaagaggaagattcaaagtagaaaaacaagtataccaaaaactagaaaaaatgctaatagaaaaattaaactacctagtattcaaagacaatgaattcgacaaagccggaggagtattaagagcctatcaattaacagcaccatttgaaacattcaaaaaaatgggcaaacaaaccggaattatatactacgtaccagccgacttcacctcaaaaatatgcccagtaacaggattcgtaaaccaattatacccaaaatacgaaagtgtatcaaaatcacaagaattcttttcaaaatttgacaaaatatgctacaacctagacaaaggatacttcgaattctcattcgactacaaaaacttcggagataaagcagcaaaaggaaaatggacaatagcatcattcggatcaagattaataaacttcagaaactcagacaaaaaccataactgggacacaagagaagtatatccaacaaaagagttagaaaaattattaaaagactacagcatagaatacggacacggagaatgcataaaagccgcaatatacgcagaaaacgacaaaaaattcttcgcaaaactaacatcaatattaaactccatattacaaatgagaaacagcaaaacaggaacagaattagactacttaatatcaccagtcgccgatgtaaacggaaactttttcgacagccgacacgcaccaaaaaacatgccccaagacgcagacgcaaatggcgcctaccacataggcctaaaaggattaatgttactctatcgaataaaaaacaaccaagacggaaaaaaactaaacctagtaataaaaaacgaagaatacttcgaattcgtacaaaacagaaacaaatcaagcaaaatatga

SEQ ID NO: 9265 - RNA, 3792 nt, synthetic construct
  misc_feature 1..3792: note = Cpf1 variant
  source 1..3792: mol_type = other RNA
atggaagactatagcggatttgtcaacatctactcaatacaaaaaacattgagatttgaactaaaacctgtcggaaaaacattagagcatattgaaaaaaaaggatttctaaaaaaagacaaaatccgtgccgaagactacaaggcagtaaaaaaaattatcgacaaatatcaccgcgcctatatagaagaggtattcgacagtgtactacatcaaaagaaaaaaaaagataaaacacgattttcaacccagttcatcaaagaaataaaagaattcagcgaattatactacaaaaccgaaaaaaatataccagataaggaacgattagaagcactatcagaaaaacttagaaaaatgctagtaggagcgttcaaaggtgaattttcagaagaagtagcagaaaaatacaaaaatttattttcaaaagaactaattagaaacgaaatcgaaaaattttgcgaaacagacgaagaaagaaaacaagtatctaacttcaaatcctttacaacatatttcaccggattccacagtaatagacaaaatatttacagcgacgaaaaaaaatcaactgccataggctaccgcattattcaccaaaatctaccgaaattcctagacaatctaaaaataatcgagagcattcaacgcagattcaaagatttcccctggagtgatcttaaaaaaaacctgaaaaaaatagataaaaacatcaaactcaccgaatatttctcaatagacggattcgtaaacgtactaaatcaaaaaggtatagacgcctataacacaatactaggaggtaaaagcgaagaatccggagaaaaaatacaaggcctaaatgaatacataaatctatacagacaaaaaaataatatagatcgtaaaaacctaccaaatgtaaaaattctttttaaacagatactgggtgacagagaaacaaaatcattcatacctgaagcttttcctgacgaccaatctgtacttaacagtataactgaattcgcgaaatatctaaaattagataaaaaaaaaaaatctatcattgcagaacttaaaaaatttttaagttccttcaatagatacgagttagatgggatttatctagcaaatgacaatagcttagccagcatatcaacatttctatttgatgactggtcgtttatcaaaaaaagcgtttcatttaagtacgacgaatccgtcggcgatccgaaaaaaaaaataaaaagtccactaaaatacgagaaagaaaaggaaaagtggttaaaacaaaaatattatacaataagctttctaaatgatgcaattgagtcctactcaaaatctcaagacgaaaaacgagtaaaaatacgactcgaagcctattttgcggagttcaaatctaaggatgacgcaaaaaaacaattcgatttattagaaaggatcgaagaagcatatgcaatagtagaaccattactgggagcagaatatccaagagacagaaatcttaaagcagacaaaaaagaagttggcaaaatcaaagacttccttgacagtataaaatccctacagttcttcttaaaaccattactaagtgctgagatttttgatgaaaaggaccttggattctataaccaactcgaaggatactatgaagaaatagacagcatcggacacctttacaataaggtccgaaactatctcactggcaagatatattctaaggaaaaattcaaactaaacttcgaaaacagcaccctactaaaggggtgggatgaaaacagagaagtagctaacttatgcgtaatattcagagaagatcaaaaatactacttaggtgtaatggataaagaaaacaatacaattctctcagatatcccaaaagtaaaacctaatgaactgttctacgaaaaaatggtatacaaactaatacccaccccccacatgcaactcccgagaatcatcttcagctctgataatttaagcatttataacccaagtaaaagtatattaaaaatcagggaagccaaaagctttaaagaaggaaaaaatttcaagcttaaagactgtcataaatttatagacttctacaaagaaagcataagtaagaacgaagactggagccgatttgattttaaattctccaaaacatccagttacgaaaatatatcagaattttatagggaagtagaacgacaaggttacaatttagactttaaaaaagttagcaaattttatatagattcattggtcgaagatggtaaattatatctttttcaaatctataacaaagacttcagcatatttagtaagggaaaaccaaacttacacacaatatacttccggtccttattttcgaaagaaaacctcaaggatgtatgcctcaaactcaacggcgaagcagaaatgttcttcagaaaaaaatcaataaactatgatgagaaaaaaaaacgagaaggacatcatcccgaacttttcgaaaaactaaaataccccatattaaaagacaaaagatactcagaggacaaatttcaattccacttaccaatctccttaaattttaagtcaaaagaacgtcttaacttcaacctcaaagtaaacgaatttttaaagagaaacaaagatataaacataataggaatagatcgaggagaacgaaacctcctgtatctagtaatgataaatcaaaaaggagaaatattaaaacaaacactactagacagcatgcaatctggaaaaggaaggccagaaatcaattacaaagaaaaactacaagaaaaagagatagaaagagacaaggctcgaaaatcgtggggaaccgtcgaaaacataaaagaacttaaagaaggatacctctccatagtcatacaccaaatatcaaagctcatggtagaaaacaacgctatagtagttctagaagacctcaatatcgggttcaaacggggcagacagaaagtcgaaagacaagtctaccagaaattcgaaaaaatgctaatagacaaacttaacttcttagtattcaaagaaaataaaccgacagaaccaggaggggtcttaaaagcataccagctcacagacgaatttcaaagttttgaaaaactctccaaacaaacaggattcctcttctacgtcccatcctggaatacatcaaaaatagacccccgcacaggctttatcgattttctccacccagcgtatgaaaatatcgagaaggccaaacagtggattaacaaattcgacagtatacgattcaactcaaaaatggattggttcgagttcacagcagatacaagaaaattttcggaaaaccttatgttaggaaaaaacagagtatgggtaatatgtacgaccaatgtagagagatatttcacaagcaaaacagccaacagttcaatacaatacaactcaatacaaattacagaaaaacttaaagaattattcgtagatatcccttttagtaatggtcaagatctaaaacccgaaatactcagaaaaaacgacgccgtattcttcaagtcattactattttatattaaaacaactttaagtctaagacaaaataacggaaaaaagggggaagaagaaaaagactttatcctaagcccggtcgtagacagtaaaggaagattctttaactcgctagaagcatcggacgacgaaccaaaagatgcagatgccaatggcgcataccacatagcgctcaaaggactcatgaatctacttgtactaaacgaaacaaaagaggaaaacctcagtagaccaaaatggaaaataaaaaacaaagattggctagaattcgtctgggaaagaaatcgatga

SEQ ID NO: 9266 - RNA, 2820 nt, synthetic construct
  misc_feature 1..2820: note = Cpf1 variant
  source 1..2820: mol_type = other RNA
atgaacctatactccaatctcacaaacaaatactctctttcaaaaacactccgattcgaattaatcccacaaggagaaactctcgaaaatataaaagcacgcggcctcatactagatgacgaaaaaagggcaaaagactacaaaaaagccaaacaaataattgacaaatatcaccaattcttcatagaagaaatactcagctcagtatgtatttccgaagatctactacaaaactactcagacgtatatttcaaactaaaaaaatcagacgacgacaatttacaaaaagatttcaagtcagccaaagacacaataaagaaacacatcagccgctatataaacgactcagaaaaattcaaaaatctatttaaccagaacctaatagatgcaaaaaaaggccaggaatccgaccttatcctctggcttaaacaatcaaaggacaacggaatagaactatttaaagcgaatagcgacataacagacatagacgaagcactagaaataattaaaagttttaaaggctggacgacttatttcaaaggatttcatgaaaaccgaaaaaacgtatactccagtgacgacataccaacttctatcatctaccgtatagtagacgacaatctaccaaaattcatagaaaataaagctaaatatgagaacttaaaagacaaagcaccagaagccatcaactatgaacaaattaaaaaggatttagctgaagaattaacattcgatatagattacaaaacatcagaagtaaaccaacgcgtattctcactcgatgaagtattcgaaatagcaaactttaacaattacctcaaccaatccggcataacaaaattcaatacaataattggaggcaaattcgtaaacggagaaaataccaaacgaaaaggaataaacgaatacattaacctgtactcacaacaaataaacgataaaaccctcaaaaaatacaaaatgtccgtattattcaaacaaatactaagtgacactgaatcaaaaagcttcgttattgataaactcgaggacgattcagatgtggttacaacgatgcaaagcttttacgaacaaatagccgcttttaaaactctcgaagaaaaatctattaaagaaactctatctctcctattcgacgacttaaaagcacaaaaactagacctatcaaaaatctacttcaaaaacgataaatcactaacagacctttcacaacaagtatttgatgattattcagtcataggcacagcagttttagaatacataacacaacaagtagcacctaaaaacttagacaacccatcaaaaaaagaacaagacctaatcgctaaaaaaaccgaaaaagccaaatatctaagcttagaaactatcaaactagcattagaagaattcaacaaatatcgagacatagataaacaatgcagattcgaagaaatattcgcatcttttgcagacatccccgtactattcgacgaaatagcccaaaataaaaacaacttagcacaaatctcaataaaataccaaaaccaaggaaaaaaagatttactacaaacatcagcagaagtcgacgttaaggctataaaagacctattagaccaaactaacaacctactccacaaactaaaaatatttcatattactcaatcagaagacaaggcaaatatccttgacaaagatgaacacttctacttagtatttgatgaatgttactttgaactcgcaaatatagtagctctctataataaaattcgtaactatattacgcaaaaaccctacagtgatgaaaagtttaaactaaatttcgaaaactctacgttggccaacggatgggataaaaataaagaaccagacaacaccgcaatcctgttcatcaaagacgacaaatactacctgggagtcatgaacaaaaaaaataataaaatattcgacgacaaagcaatcaaagaaaacaaaggagaaggatacaaaaaagtcgtttataaactacttccgggtgccaataaaatgcttcccaaagtatttttctcagccaaaagcatcaacttttacaacccctccgaagacatactccgcatacgcaatcactccacacatacaaaaaacggatccccacaaaaaggttatgaaaaactagaattcaacatagaagattgccgaaaatttatagatttctacaaacactctataagccgacaccctgaatggaaagatttcggattcagattctcagacacaaaaaaatacaactcaatcgacgaattttacagagaagtcgaaaaccaaggctacaaattaacatttgaaaacatcagtgaatcatacatcgactcattagtagatgaaggaaagctttacctctttcaaatatataacaaagacttttcagtatactccaaaggtaaacctaacctacacacactttattggaaagcactattcgacgaacgaaatctccaagacgtagtatacaaactaaacggagaggcagaacttttctatagaaagcagagtataccaaaaaaaataacccaccccgcaaaagaagccatagcaaacaaaaacaaagataaccccaaaaaagaaagcatatttgaatacgacctaatcaaagacaaaagatttaccgaagacaaattttttttccactgcccaatcaccataaattttaaatcctcaggcgccaacaaattcaacgatgaaataaacctgctcctcaaagaaaaagccaacgatgtccatatactttccatcgaccgaggggaacgacacctagcttactacaccctagtagatggaaaaggcaatataatatgcaaaaattga

SEQ ID NO: 9267 - RNA, 3795 nt, synthetic construct
  misc_feature 1..3795: note = Cpf1 variant
  source 1..3795: mol_type = other RNA
atgctctttcaagagttcacacatctatatccactgagcaaaacggtaagatttgaacttaaacccatagggaaaacactcgaacacatacatgccaaagattttctatctcaggatgaaacaatggcagatatgtatcaaaaggtaaaagcaattctcgatgattaccatcgagatttcatcgctgacatgatgagcggagttgtactcaccaaattagctgagttctacgaagtctatctagctctacgaaaaactccaaaagacgactctctccaaaagcaactcactgaaatacagactgcccttcgcaaagaaatagtgaaaccaataggttcgggaggaaaatataaagcaggatacgataggctattcggtgcaaaactatttaaggatggtaaagaattaggagatctagccaaattcgtaatcacacaagaaggcgaatcttcacctaaactagcccacatagcccatttcgaaaaattctccacatattttacaggattccatgacaatcgcaaaaatatgtactcagacgaagacaaacacacagcaatcgcatatagactcatccatgaaaacctccctagatttattgataatctacaaattctagcaacaataaaacaaaaacattccgccctctacgatcaaatcgtaaatgaacttaacgcaaatggtctagacgtttccctagcctcccatctagacggatatcataaacttctcactcaagaagggatcactgcttataacaccctcctcggcggtatatcaggtgaagccggatcaagaaaaatacaaggtataaatgaattaataaacatccatcataatcaacattgccaaaaatcagaaagaatcgccaaattaagaccactccacaagcaaatactctcagatggaatgggagtctccttcctcccaagtaaatttgcagacgattccgaagtttgtcaagctgtaaacgaattttacagacattacgcacatgtttttgcgaaagtccaatcactttttgatcgattcgacgattaccgcaaagacggaatttatgttgaacacaaaaatctcaatgaattatctaagcaggcattcggagatttcgccctacttggaagagtcctagatggatattatgtagatgtagtaaaccccgaatttaacgaacgattcgcaaaagcgaaaaccgataatgcaaaagaaaaattaactaaggaaaaagacaaattcataaaaggagtccattcacttgctagccttgaacaagcaatcgaacactatatagcaggtcacgatgatgaaagcgttcaagcaggtaaacttggccaatattttaaacacggattagctggtgtcgataatccaatccagaaaattcacaatagccactcaacaatcaaaggcttcttagaacgagaacgtcccgctggtgaacgcgctctaccaaaaataaaatccgacaaatccccagaaatgacacaactgagacaattaaaagaattactagataatgcactaaatgtcgtacacttcgcgaaactattaaccactaaaacgacgctcgataaccaagacggcaacttctatggcgagttcggcgcattatacgatgaactagccaaaattgcaaccctatacaacaaagtaagagactaccttagccaaaaacctttctccaccgaaaaatacaaactcaacttcggaaatcctactctattaaacggatgggacctaaacaaagaaaaagataacttcggagtgatattacaaaaggacggctgttattacctagccctactagacaaagcacataagaaagtatttgacaacgcaccaaatgcaggaaaatcagtatatcagaaaatggtatacaaacttctacccggaccaaataaaatgttaccaaaagtatttttcgccaaatctaacctagattattacaatccaagtgcagaactactagataaatacgcacaaggaacacacaagaaaggaaataacttcaacctaaaagactgccacgcattaatcgactttttcaaagcatcaataaacaaacacccggaatggcaacatttcggctttgagttttcgccaaccagttcttaccaagatctatcagacttctatagagaagtagaacctcaaggatatcaagtaaaatttgtagacatcaatgcagaatatatagacgaattagtcgaacaaggccaattatacctctttcaaatatacaataaagacttctcgccaaaagcacatggaaagccaaacctgcacacgttatactttaaagccctattctcagaaaacaacctagcgaatccgatatataaattaaacggagaagcagaaatattttatagaaaagcaagtctagacatgaacgaaacaactatacatcgggcaggagaagtactagaaaacaaaaaccctgataacccaaagaaacgtcaatttgtatacgacatcataaaagataaaagatacacacaagataaattcatgcttcatgttcctataacaatgaactttggggtacaaggaatgaccataaaagagttcaataagaaagtcaatcaaagtatacaacaatataacgacgtaaacgtcataggcattgatcgcggagaaagacatctattatatctgacagtaataaattcaaaaggtgaaatactagaacaacgatcactcaacgacatcatcacaacatcagcaaacggaactcaaatgacaactccctatcacaaaatcctagataaacgagaaatagaacgtctaaatgcccgagttggctggggcgaaatcgaaacaattaaagaactaaaatcaggctacctctctcatgtcgtacatcaaatatcacaattgatgctcaaatataatgctatagtagtactagaagatttaaactttggtttcaagagaggccgattcaaagtagagaaacaaatctatcaaaattttgagaacgctctaatcaagaaattaaaccatcttgcactaaaagacaaagcagacgatgaaatcggctcatacaaaaacgccctacagctaacaaataacttcactgacctaaaatccattggcaaacaaacaggattcttattttacgtacccgcatggaatacttcaaaaatagatcccgctaccggattcgttgatcttttaaaaccaagatatgaaaacatagcacaaagtcaagccttctttggcaaattcgacaaaatattttacaatgctgacaaagggtattttgaattttatgtagattatgctaaattcaccgacaaagccaaaaactctagacaaacatgggtaatctgtagtcacggagataaacgatacgtttacgacaaaacagctaatcaaaataaaggagcaacaataggaattaacgttaacgacgaactaaaatcactttttgcacgataccacatcaacgataaacagcccaacttagtaatggacatatgccaaaataacgacaaagagttccataaaagccttatgtacttactcaaggcattactagcattaaggtattccaacgcctcttctgatgaagacttcattctatcacctgtcgctgacgacaaaggagtattctttaattccgctctagctgacgacacacagccacaaaatgccgacgctaacggggcatatcacatcgcactaaaaggtttatggcttttaaacgaattaaagaactcaaatgatttggataaaataaaactagccatagacaaccaaacatggctcaactttgcacagaatagatga

SEQ ID NO: 9268 - RNA, 3903 nt, synthetic construct
  misc_feature 1..3903: note = Cpf1 variant
  source 1..3903: mol_type = other RNA
atgtcaatatatcaagagtttgtaaataaatactcactatccaaaactctacgattcgaattaataccacaaggaaaaaccctagaaaacataaaagccaggggcttaatactcgacgatgaaaaacgtgcaaaggactacaagaaagctaaacaaataatagataagtaccaccagttcttcatcgaagaaattttaagttccgtctgtatatcagaagacttactccaaaactattcagacgtctatttcaaacttaagaaatccgacgacgataatctacagaaagatttcaaatcagcaaaagatacaatcaagaaacaaatatcagaatacattaaagactcagaaaaatttaaaaacttattcaaccaaaaccttatagacgccaagaaaggccaagaaagtgatctaatcctctggctcaaacaatcaaaagacaacgggatagaactttttaaagcgaatagcgacataaccgatatagacgaagcactggaaataattaaatcatttaaagggtggacaacatacttcaaaggattccatgaaaatagaaagaatgtatacagttctgatgatatccctacaagcataatttaccgaatagtagacgacaacttaccgaaatttctcgaaaataaagcaaaatacgagagcttgaaagacaaagcaccagaagctataaactacgaacaaattaagaaagacctagccgaagaactcaccttcgatatagattataaaacctcagaagtcaatcaaagagttttctcgctcgatgaagttttcgaaattgcaaatttcaataattatctgaaccaatcaggaataacaaaattcaacaccatcatcggcggaaaattcgtaaacggagaaaacacaaaaagaaaagggataaatgaatatatcaacctatattcccaacaaataaacgataaaactctaaagaaatataaaatgagcgtattattcaaacaaattttatcagacaccgaaagcaaatcattcgtcatagacaaactcgaagatgactcagacgtagtcaccacaatgcaatcattttacgagcaaatcgcagccttcaaaacagttgaagaaaaatcaataaaagaaacgctatccctattattcgatgacctaaaagcacaaaaacttgacctttccaaaatatattttaaaaacgacaaatccttaacagatctctcccaacaagtttttgacgactactcagtaataggaacagcagtattagaatatataacccaacaagtagcccctaaaaatctagacaacccatccaagaaagaacaagaccttatcgccaagaaaacagaaaaagcaaaatacctttcattagaaacaataaaattagccttagaagagttcaacaaacatcgagatatagacaaacaatgccgattcgaagaaatattagcaaatttcgctgcaataccaatgatctttgatgaaatagcccaaaacaaagacaatttagcacaaatctccctgaaataccaaaaccaaggcaaaaaggatcttcttcaagcgtccgcagaagaagacgtcaaagcaataaaggacttattagatcaaactaataacttgcttcacagactaaaaatttttcatataagccaatctgaagacaaagccaacatactagataaagacgaacacttctatctagtatttgaagaatgttactttgaactcgcaaatatagtaccactctataacaaaataagaaactacataacccaaaaaccatattcagatgaaaaattcaaactaaattttgaaaattccacactagcaaacggctgggataaaaataaagaaccagacaacaccgctatcttattcataaaagacgataaatactacctcggtgttatgaacaagaaaaataacaaaatatttgatgataaagcaataaaagaaaataaaggggaaggctacaagaaaatagtttataaattactgccgggtgcaaataaaatgctaccaaaagtcttcttttcggctaaatctataaaattttacaacccatctgaagatattctccggataagaaaccactcaacacacaccaaaaacggcaatccacaaaaaggttacgaaaaatttgagttcaacattgaagactgcagaaaatttatagacttctataaagaatcgatatcaaaacacccagaatggaaagacttcggctttcgtttttccgacacccaacgatacaattccatagatgaattttaccgcgaagtcgaaaaccaaggatacaaactaacgtttgaaaacattagcgaatcatacatcgacagtgtagtgaatcaaggaaaattatatctcttccaaatctacaacaaagactttagtgcatactcaaaaggaagaccaaatttacacaccttatactggaaagcgcttttcgacgaacgaaatctgcaggatgtagtatacaaactcaacggagaagccgaacttttctacagaaaacaatccattcccaagaaaataactcaccccgctaaagaagccatagctaataaaaataaagacaacccaaagaaagaatcagtattcgaatacgacctgataaaagataaaagatttactgaagacaaatttttcttccactgtccgataactataaacttcaaatcctctggagcaaataaattcaacgacgaaataaacttattattaaaagaaaaagccaacgacgtacatatattatcaatagatagaggggaacgacacttagcatactatacactcgtagacggaaaaggaaatatcatcaaacaagatacattcaacattataggcaacgaccgtatgaaaacaaactatcatgacaaattagcggccatagaaaaagaccgagatagtgctagaaaggattggaaaaagatcaataatataaaagaaatgaaagaaggatatttaagccaagtagtacatgaaatcgctaagctagtaatagaacataatgcaatcgtagtatttgaagacttaaactttggatttaaacgaggaaggtttaaagtagaaaaacaagtatatcagaaactagagaaaatgctcatagaaaaactaaattaccttgtctttaaagataacgagttcgataaaaccggcggagtactcagagcttaccaattaacagcaccattcgaaacatttaagaaaatgggaaaacaaacaggcatcatctattacgtaccagcaggatttacctcaaaaatctgtccagtcaccggattcgttaatcaactatatccgaaatatgaatcagtaagcaaatcacaggagttcttttccaaattcgacaaaatctgctataacttagacaaaggttacttcgagttctcttttgactataaaaactttggagataaagcggcaaaaggaaaatggacaatagcatcctttggttcacgtttaattaactttagaaactcggacaaaaaccataactgggacacacgcgaagtataccccacaaaagaattagaaaaactattaaaagactatagtatagaatatggacatggagaatgcataaaagcggctatctgcggagaaagtgataagaaattctttgcaaaactaacatccgtactcaacaccatactacaaatgcgtaatagcaaaacagggaccgaactagactatttaatctcgcctgtagcagacgtaaacgggaatttctttgacagcagacaagctcccaaaaatatgcctcaagacgctgacgccaacggagcctaccacatcggcctaaaaggattaatgctactcgatcgcatcaaaaacaatcaggaagggaagaaattaaacctcgtcattaaaaacgaagagtattttgaatttgtacaaaacagaaacaattga

SEQ ID NO: 9269 - RNA, 3756 nt, synthetic construct
  misc_feature 1..3756: note = Cpf1 variant
  source 1..3756: mol_type = other RNA
atgaatcatatgaaacaattcaccaatcaatttagccttagtaaaacattacgttttgaactcataccacaaggaaaaaccaaagagttcatagaaataaatggcctaatcgaaaaagacaatgaacgagcagtctcatacaagaaagtaaagaaaattatcgatgaatatcacaaatattttatcgaaatggtactttgcgacttcaaactgcacggactagaaacttatgaaaccatctttaacaagaaagaaaaagatgatactgataagaaagagttcgataacattcgcaatagtctccgaaaacaaatagctgacgctttcgcgaaaaacccaaacgacgaaatcaaagaacgctttaagaacttatttgcaaaagaactaataaaacaagatctactcaacttcgtagatgacgaacaaaaagaactcgtaaacgagttcaaagactttacaacctattttacgggattccaccaaaacagacgcaacatgtacgtagcagacgaaaaagcaacagcaatagcttaccgtctagtcaatgaaaacttaccaaaatttatagacaatctcaaaatatacgaaaagattaagaaagacgcgcccgaactcataagtgacttgaataaaactctagtagaaatggaagaaatcgtacaaggaaaaaccctcgacgaaatattttccctctctttcttcaatcaaacgttaacccaaacaggcatagaactatacaatatagtcataggaggccgaacagcagatgaaggaaaaacaaaaatcaaaggcctaaatgaatatattaatacggactataaccaaaaacaaacagataaaaagaagaaacaagccaaatttaaacaactgtacaaacaaatacttagcgaccgacattccgtctctttcgtcgccgaaacatttgaaacagatgcgcaattactagaaaacatagagcagttttacagttcagtactctgcaattacgaagacgacggacacactacaaacatatttgaagctatcaaaaacctcatcatcggattaaaaacattcgacctttcgaaaatctatctaagaaacgatacatccctcacagacatcagccaaaaactattcggtgactggagcataatatcatctgccctcaatgattattacgaaaaacaaaatccaatctcatccaaagaaaaacaagaaaaatacgacgaaaggaaagcaaaatggttaaaacaggacttcaacatagaaacaatacaaacagccctaaacgaatgcgactcagaaataattaaagagaaaaataacaaaaatatcgtctccgaatatttcgcaaaacttggtcttgataaagacaacaaaattgatcttttacagaaaatacatcataactatgttgttataaaagatctgctcaacgaaccttaccccgaaaatataaaactgggaaaccaaaaagaacaggttagccaaataaaagacttcttagattcaatattaaacctaatacatttcctcaaacccctatctttaaaagacaaagataaagaaaaagatgaacttttctatagcctatttaccgctctattcgaacatttaagccaaaccatatcaatctataataaagtcagaaattatctaactcaaaaagcatatagtacagagaaaataaaactaaattttgaaaatagtaccttattgaacggatgggatgtaaacaaagaaccggttaatacatctgtaattttcagaaagaatggactgttctacctaggaatcatgtcaaaatccaacaacagaatttttgaacgaaacgtaccagtatgcaaaaatgaagaaaccgcatttgaaaagatgaactataaattactcccaggagctaataaaatgctacccaaagtttttctttcagccaaaggcatagaatccttccaacccagcgcagaaatacagtcaaaatatcaaaaagaaacacacaaaaagggtgacgcctttgttagaaaagatatggaaaacttaatagacttctttaaacaatcaatagctaaacatacagattggaaacactttaatcaccaatttagcaaaaccgaaacatataacgatctttccgagttctataaagaagtagaaaaacaaggatataaactaacattcactaaacttgacgaaacctacataaaccaattagtcgacgaagggaaattatatttattccagatctacaataaagacttttcccctttctcaaaagggaagccaaatatgcatacgttatactggaaaatgttattcgacgaacaaaaccttcaaaatgtagtttataaacttaatggagaagctgaagttttcttccgacagagttcaatcaaacaaactgaccggatcattcacaaagcaaaccaagcaatagacaataaaaatccactaaataataagaaacaatccagttttaattatgacctaattaaagataaaagattcacactagataaatttcaatttcatgtgccaatcacgctaaatttcaaagctgaaggtaatgaatacctaaacacaaaagtcaacgaatacctaaaatccaacagtgacgtaaaaatcataggactagatagaggagaacgacatttaatttacttgacactcattaaccaaaaaggggaactcctaaaacaacaaagcctaaacgtaatagccacgtcacaagaacacgaaaccgattacaaaaacctgctagtcaataaagaaaacgaacgcgcaaacgcaagacaagactggaaaacaatagaaactataaaagaactaaaagaaggctacttatcacaagtagtacatcaaatcgccacaatgatggtagatgaaaacgccatcgtagtcatggaagatctaaatgcaggttttatgagaggacgacaaaaagtcgaacgacaagtttaccagaaactagagaaaatgctaatagaaaaactaaactacttagtcttcaaaaataacgacgtaaatgaaacagccggtgttcttaacgcacttcaattaacaaataaatttgaatcctttgagaaaatgggaaaacaatctggatttttattttacgtaccagcctggaatacaagtaaaatagacccagcaaccggcttcgtagacttcctcaaacctaaatatgaatctgtagaaaaagcaaaattatttttcgaaaaatttgaatcaataaaatttaacgccgacaaaaactatttcgagttcgaatttgattataagaaattcactgaaaaagccgaaggatcccagaccaaatggacagtatgtacacacagtgatgtaagatataggtacaatcctcaaaccaaagcatcagacgaagtaaacgtgaccaatgaattaaaactaatattcgataaatttaaaatagaatacaaaaacggcaaaaacctgaaaacagaactactactccaagacgacaaacaactcttttccaaacttctacactacctcgccctaaccctaatgctacgacaaagcaaaagcggaaccgacatagacttcatactctctccagtggctaaaaatggagtattttacgactccagaaacgcaatgccaaatttaccaaaagacgccgacgcaaatggagcatttcacattgcactcaaagggttatggtgcgtccaacaaatcaaaaaggccgatgatctcaagaaaataaaactagccatctccaataaagaatggttatcatttgtacaaaatcttaaatga

SEQ ID NO: 9270 - RNA, 4173 nt, synthetic construct
  misc_feature 1..4173: note = Cpf1 variant
  source 1..4173: mol_type = other RNA
atgatagataatacaaaagaaaagaaagaagggagtgtgttcgacggattcacaagaaaataccaactatcaaaaactctcagattcgaattacgcccaatccttaacacacctaaaatgctagacgacgaacaagtaatcaaaaacgacgaaacacggcgcaagaaatatgaagcagtaaaaccatggttcgatcaactgcacagggagttcatagaagacgccttaaaatcattcaaatttaaaaatctagcaatctaccaagatacattccaaacttggcaaaaagatagaaaatcaaaacagaagaaagataccctagtcaaaatagaagtcggactcagagaagaaatagtcagaaggtttgaagaagtagccaatatatgggttagatcagaacaatacaaacttttaggcatcaagaaagaaggattaggtatgctattcgaagcaggggtatttagattgttaaaagaaagattcaaaaacgaaaaagacacaaccgtagacggaaacaacatattcgacgaatggacgagatggacgggatacttcaagaaattctttgaaacacgtaaaaacttttacaaaagtgacgacacctcgacagctatcgcatacagagtaataaaccaaaatctgagacgtttttgtgaaaatatacaaattttcgagaaaatttcagagaaaatcgaattttcggaagtagaaaaatcctttgacatttcatgcgcagggatattcagcctagcgtactacaacgcatgcctgcttcaagggggaattgacacatacaataaaataatcggcggtgaagtcgatgaaaaagacaagaaaatacctggaatcaatgaattaataaacaaataccgacaagacaacagcggtgaaaagataccattcctcaaacaactggataaacaaattcactcagcaaaagaagccttcatagaatcaatagaaacgaataaagaacttgtgggaaaactaaaaacattttacgaaaatgctgaagtcaaaatacaaagttttagaaacctcatagcggatatagtgaccgattacagcggttacgacattgacaaaatatatctaaccaaagaagccgtaagccataacgctagtagatggttcgctagcttcgaatcattcgaacgtgatttgttcgctgtagtcgcagaaaaacaaaacaaacttgtttacgaattacttagaacacacaaaaatgactcaaaaattagtgataaagatggtaaattttccttccccgacttcataaaatgctcgcatataaaaagagccctagaaaaacaggaaggaagaatatggaaaggagaatactatgaagacatcgtagactttgaaaagataaaagatgtatttacacagtttctatgtgtttttaaattcgaactagaacaacaattcttcagaaaaacaactagcgcgcagacaggtgaacaaacaaaaattggatacgaaatcttcgtaacaaaaataaatgaattaataacgagggaaaatcccgtgatcgacttagaagaaaagatagctatcaaaaactttgccgacgcaacattactcatataccaaattgcaaaatatttcgcagtagaaaaacgacgtggatggctggataactacgacttagacgatagattctataaatcatctgatataggatacctcaatttctacagagatgcctttgaacagatagtccggccttataacctatttaggaattatctaaccaagaaaccttataacactaacaaatgggtattatcattcgaaaacccaaccttagcagacggatgggacaaaaacaaagaaaagacaaacgccgcggtaatactacgaaaagatggccgatactatctaggaataattaaagaagattgcaaaagtctgttcgctgacagatacagtaaagaaatgagcgaaggtattgaatcaggtagcttccagaaaatggcatataaattcttccccgaagcaagtaaaatgataccaaaatgtagtacccaaacgaaaaacgtaaaagaacattttagaaaatcaagcagcgattacaacctatttcacgaaaaagattacaaaatatcagtcgctataaccaaaaatatttacgaactgaacaatgtattttatagaaaagataatatcgaagaatcattcgtacctaaaaatgatttcgaaaagaaacttggagttaagaaattccagcgacaatatttggaaataagtagggacaacaacggatataaacaagccctcgctcagtggattgaattttgtataagatttcttaaagcatacaaatcaacaacaatattcgactatagtaggctaagagaagcaaaagaatatgaatcacttgacgctttttaccaagacataaacgcattgacatataatatctcattcgtaccgatatcggaacaatacataaaagagaaaaatgataacggagaactatttctatttgaaatatataacaaagactggagcttaggacctatggataaaaacagaaaaagaactaaaaatctacacacactatacttcgaacaattattttccaaggaaaacgaacaagaaaactttctctttcagttaaacggagaagcagaactattcttcagaccaaagacggaagagaaaagactaggatacaaagtatgggatgcaggagagaagaaatgggtgaaagcaaaagaaaaagaagacggggcagtcatagatcgaaaaaggtatgcaaaagacattatactttttcactgccccataacacttaacagagtgtccgaatcgaagacaaaaagagaaatggatgtagaaattagagaagtactatcaagcaccccaggcgtacacataataggagtggacagaggcgaaaaacatctcgcttattattcagtaatcgatcagaatggaaaaataatcgaaacagataccttaaactcaataggaaaagacggacgcggcaagcccgtagaatatgcatcaaaactcgagaaaagagcacaagaaagagaagcctctcgaagagactgggaagaagtcgaagcaataaaagatcttaagaaaggctatattagtcaagtaataagaaatctcgcagatctaataataaaacataatgccataatcgttttcgaagatcttaacatgcggttcaaacaaataagaggaggaatcgagaaaagtgcttaccaacagctagaaagagcattaatagacaaactatcatttctagtcaagaaaggcgaagaagaccccaaacaaacaggacatatattacgcgcgtatcagctagcagcaccagtcattgcatttaaagatatgggaaagcaaaccggacttatattttatacacaagcaggatacaccagtaaaacatgtccggaatgtgggtacagacgaaatataaaatgtctattcgagaacatagaacaagcaaaaactctcatagaaaatttagaatccattaattacaataagaaagaagatgtatttcaaataagctatagcctagagaaattatcatccaaagaccagaagaaagagaagaaagtgagcaacgaactttatgccaaaacgttaaagaaagatatcttcatcctcactacgaaaaatgcacttagatacaaatggtacgacaggtactcagaaaaagctaaagtagcaaaaaggggaatagacgaatacaaaggtgaagtaaatgagagcgaaaccaagaaaggagtagttaaagagttcaatctaaccgaatacttaaaaggactactaaaaacatatgagatcgactatgagcatgggggaatcagagaacagatcctatctgtagcacgaggtcgagaattttacaaagactttctttacgcgttattccttcttaccgaaacaagacactcaatatcaggtagaaacacagattatatacaatgccctgaatgcgaatttgattcaagaaaaggtttcaaggatataaaagaatttaacggcgatgccaacggagcgtataacatagctaggaaaggcataatgatattagagaaaatcaaacagtttaagaaagataatgacggaaatttagagaaaatgggatggggcgatttgtcgatatcaatagaagaatgggataagttcacccagaaagaatga

SEQ ID NO: 9271 - RNA, 4026 nt, synthetic construct
  misc_feature 1..4026: note = Cpf1 variant
  source 1..4026: mol_type = other RNA
atgaacgcagaaaaaaaatgcgccttcaatgaattcacaaacttatacgaattaagtaaaacgttaaaatttgagcttaaacctgttggaaagacaaaagaaatcatcaaaaacttccgagaagaacttgaaaaaaacaatcccatacaattagacaaagagatttccatagcaaaacaggaaattaagaaagacctagatatcctacacagagaattcgttagacaatcctttgaattggcattcaaagaaaacaaaataaactatgaaatatttttcgaaatataccgaaatttcaagaaattttcaaaaaacaaaaaatcagacgaatacattgcggctatcaaaaacctaaaagaagaaaaaataaagctagtcaaaaaaatagcagactacttcgtcaaaatggaccaagaatggcgcaaatattaccccagcgaaaaaaaaagcttcctcttaatgagcaatggcgttatcaatctacttatcgatatcaataaagacagaatggattactcattcatacccaaagaagtttgcgaaaagattaaaggtaaaggcaaaatagaactatacgaaaaatttaacaaacatttcggatatctctcaaaatataacacggcaagagagaatttttacagtgacgacgtcaaaaacagcgcaagtgttgcatacagggccatatgcgagaacttagaaaaattttgcgacaataagattaaagtagaagcggacaactttcctaaagaaataaaagaaaaatttctagaatattttaataaaattaccgatctatcattctacaatagatgcctaagccaaaacggaatagaggaatatcataaattcaaagatgaaataaatcgaagtataaatgaattataccccaacaatagcaaaaacaaaccccaaaacataccatatctttctaaattagacaaacaaatactatcagaaaaagacaaacagtcctggatagaagaaggctttatagatgaaaataatttcatttttgaattcgaaaaatttataaaaatgaatgataaatacataccaagcgaaaaaaaactatttaatgaattcttcatattccaaaacaacgacgaagtcctccaaaaattattcctactgaagaaaacaataaacaattttgccaacatatatctcgacgaccccaaaaatctaatggatcttatgccatcaaaaggaaccaaaaagagagattatttatccctgctagaaattaaagaagctcttaactcatacgctgaaaaccaaaacataggcgaaactcagatctttaaaataaaatacgacgacgtgatagacaaaacaaaaaccccctttgaatgcttcatgaaaatttggaaatacgaatatgacctactttataacgaaggcgatggaaagaaaaacatcgaagaaggctgggagaaaatatgcgaaaagcttcaaaataaaaaggacgaattcaccggagactacggaaaatataaaaaagaaataaaagactattgcgaaatggcgctctccttaagtcaaagaattaagcacctagatatacgcattaaaaaaagagatggatccgaagacgcagataacaatcttttcgaaggagtagaaaaactagacgaattctatgatcggttattcgaaatagtagacgaacataacgcatatcaataccaccacgaatttcaagcattccttacgaaaaaaccgtataaaacagataaattcaaactaagttttgataacccgcaattactaaaaggatgggacctaaataaagaacctgattattttggcgcacttctagtcaaaaatgaaaaatacttcttggctgtctttcataaacaatatgcaaacgaaattttccgacaaaagaacaaaaatagcacagtcaaaatcaaagaggcctacgatgtattcaacggcaactattataaaaaagttgagctcaaacaaataccaaaactgtttatgaacctcccaagaatctgttttgcaaaatcaaatcaagaagagttcggactaacaattgaattagaaaaaataaaatcagaattcgacaaattccaaaaacttaaaaaagaaagacaagacaacaaccttaaatttgatcaagaaaaattcataaaactcttagcatactatagacactgtttagaaataagagaagattggaaggtatttaaatacaactttaaacctttatacaagtatagtaatttaggagaattttatagagacttagagaaagatacatataatctagacctcgttcgagtcaattcagaatatgtcgaaaaaaaacggaacgagggaaaactatatttattcgaagtttacaataaagactttagcgataagtcaatcggacggaagaacattcacagtgattattttaaaagcctcttcctaccagacaacctaacgaataaaaaaatcgcattagccgcagacgcggaaatattcttcagagaaaaaagcttaaaaaataaagacgaaataataacacagaaaaacaaaataaaaatagacaaaaataaccacaaaggagagaaagcttatagtaaaaatcgatatacagatgacaaaataatactccacttgccaataaacctaaacttcggcgaaaacaaaaaccacaaagatttcaactacgaaataaatgatagcctattaaaaaacaacagggacataaaaataataggaatagaccgcggagagaaatacttactgtactactcagtaatagatcaaaaaggcgacataaaagaaatgggagactttaacgtagtaaacggagtagattattactccaaattagtagcatatgaagagaaacgcaaacaagcccgtctagactggggagacatccaatccattaaagaactaaaagaaggttatattagccatgttatacacgagatatgcgacttaattaaaaaatacaacgcaatagtagtcttagaagacttatccatgggttttaaaagaggaagattcttcagagaaagacaagtataccaaaaatttgaactagctctattcagaaaattaaactactgggtcgacaaaaataaagaagagggggaaaaaggaagtgccctaagcgcttggcaacttacaccgaacgaaaaagactttaaagtaagccaactggagaaagcccgacaactgggcatactattctacacagctgccggatatacaagtaaaacctgcccagactgtgggtttagaaaaaacataacattgaaatacgttaacgacaaacaattaaaagaagatctcggcaaactcaaaattaacttcgtcgaagaccatttcaaaataaaatataatctattagactttgaaaaaaacaaaaaatcagaaaaagctaaagacactgtactcccaaaagaggaacgaaaaatttcttttgtggcaaattcaaaagtaatccgaatacgctggcacgatattaaaaccaaacttgctaaacgagaattagacggagaaaaaataattaaaaagttcccaaaaggagtaatcaaagaatacgacataaatatatgcttaaaaagaattattggagataaaatcgactttagcaaggactcaatcacagaacaattaataaatggaagattcggaaaagatttttactgggagttgatgtacttcctaaatctaatcctcgaaatcagaaatgtagtgagcgaaacagaaatagactacatccaatgtccagtctgtggattccactccgatgatggctttcgaggaaataaattcaacggagatgcaaacggagcgtataacatagcaaggaaaggaagactaatattagagaaaataaaccaacacaaaaatctcaaggaactaaagacgggagatctatcggtcaatatagttgaatgggataaagccgttaacaattgggacaaatttgtccaaggagataacactgaaagcaaaaatatagaaataccagcaaaagaagaaatgatatccgtcgaagtcagagagagttga

SEQ ID NO: 9272 - RNA, 4107 nt, synthetic construct
  misc_feature 1..4107: note = Cpf1 variant
  source 1..4107: mol_type = other RNA
atgaaaaaagaaaaagaattcaaatcattcggcgactttacaaatctatacgagatcagtaaaacgctacgatttgaactaaaacccgttgaaaatacccaaacaatgttagacgaagccgacgtattcggaaaagacaaagtaattaaagacaaatatacaaaaacaaaacccttcatagacaaactacatcgggagttcgttgatgaatcattaaaagatgtctcgcttagcggcttaaaaaaatactcggaagtacttgaaaactggaaaaagaacaagaaagacaaagatattgtcaaggaactaaagaaagaggaagaacgactgagaaaggaagttgtagaattctttgataatacagccaagaaatgggccaacgaaaaatacaaggaattaggattaaaaaaaaaagacataggaatcctatttgaagaatcagtgtttgacttattaaaagaaaaatacggtgaagaacaagacagtttcctaaaagaagaaaaaggagacttccttaagaacgaaaaaggcgagaaagtatcaatattcgacgaatggaagggatttgtaggatattttacaaaatttcaagaaactagaaaaaacttctataaaaatgatggtacagagacagcattagcaacaagaataatagaccaaaacttaaaacgtttttgtgacaacatagatgacttcaaaaaaattaaaaacaaaatcgatttctcagaagtggaaaaaaattttaacaaaacagcagatgttttctctctagacttttacaaccaatgcttattacaaaagggaatagacagctacaatgagttcatagggggaaaaacacttgaaaacggaaaaaaattaaaaggagtgaatgagttagtaaacgaatatcgacagaaaaataaaaacgaaaaagtaagctttttaaaactcttagacaaacaaatattaagcgaaaaagaaaaactttcattcggaatagaaaatgatgaacaactattagttgtactaaacagcttttatgagaccgcagaagaaaaaacgaaaatacttagaacattatttggggattttgttgaacacaacgagaattatgatctggacaaaacatacatatcaaaagtcgcattcaacacaatatcacataaatggacaaacgaaacgcacaaattcgaagaactcctatacggagcaatgaaggaagacaaacctattggactgaactacgataaaaaagaagacagctacaaattcccagacttcatcgccctaggctatctaaaaaaatgtttgaataacctagattgtgatacaaaattctggaaagaaaaatactacgaaaataatgctgacaaaaaagataaagataaaggatttctgactggaggccaaaacgcctgggatcaatttctacagatattcatattcgaatttaaccaactattcaactcggaggcattcgataataaaggaaaagaaataaagataggctatgacaactttcgaaaagacttcgaagaaatcataaaccagaaagactttaaaaacgacgaaaacttaaaaattgccattaaaaacttcgcagatagtgtcttatggatctatcaaatggcaaaatacttcgctattgaaaagaaaagaggatgggacgatgacttcgaactaagtgaattctacacaaatccaagcaatgggtatagtctcttttatgacagggcatacgaagaaattgtacaaaaatacaatgacttaagaaactacttaactaagaagccatacaaggaagacaaatggaaattgaactttgaaaatcccaccttagcaaatgggtttgataaaaataaagaaagtgacaacagcacagtaatattaagaaaaaaaagaaaatattacttagggttaatgaaaaaaggaaacaataaaatattcgaggacagaaataaagctgaattcatacgaaatatagaatccggagcctatgaaaagatggcatacaaatatctacctgatgtcgcaaaaatgatccctaaatgtagcacccaattaaatgaagccaaaaatcattttagaaatagcgcagacgatctagaaataaaaaaaagttttagtaatccactaaaaataaccaaaagaatttttgacctcaataacatacaatatgacaaaacgaatgtaagcaagaaaatatcgggcgataacaaaggcataaaaatttttcaaaaagaatattacaaaatctcaggagatttcgacgtttacaaatcagcactaaatgactggatcgacttttgcaaagactttctttccaaatacgattccacaaaagactttgacttctctatattaagaaagacaaaagactacaaatcacttgacgaattctatgtagatgttgcaaagattacatacaaaataagtttcacgcccgtatcagagtcatatattgaccaaaaaaataaaaacggtgaattatacttgtttgagatctacaatcaagacttcgcaaaaggaaaaatgggggcaaaaaacctacatactctatatttcgagaatgtattctcgcctgaaaatataagtaagaactttccgattaaattgaacgggaacgcggaattattctttcgaccgaaatcaatagaatctaaaaaagaaaaacgtaactttgtacgggaaatagtaaacaaaaaaagatattcagaggataagatattcttccattgcccaattacactcaatcgagagacagggagcatttatagattcaacaactacgttaataactttctaagcgaaaacaacatcaacataatcggcgtagacaggggtgagaaacacctcgcatactattcagtcatagacaaaaacggggtcaaaataggaggcggatcttttaacgagataaataaagttgattatgcaaaaaaactagaagaacgcgcaggagaaagagaacagagtcgtaaagactggcaagtggtagagggcatcaaagatctaaaaaaaggatatataagtcaggtagttagagaactcgcagatcttgcgatcaaacataatgcgataatagtattagaagacctaaatatgagattcaaacaaattagagggggaatagaaaaaagcatataccaacaattagagaaagcgcttatagacaaattatccttcttagtggaaaagggcgaaaaagacccaaaccaagcgggccacatattaaaagcgtaccaactagcagcaccatttacatcattcaaggacatggggaaacaaacaggaatagtattctatacccaagcatcatatacatcaaaaacctgtccaaactgcggattccgaaaaaacaacaacaagttttactttgaaaataatatcggaaaagctcaggatgccttaaaaaaacttaaaactttcgaatatgactccgaaaacaaatgtttcgggttatcatattgcttaagcgactttgcaaataaagaagaagtagaaaaaaacaaaaacaaaaaaagaaataatgcgccatactccgatatagagaaaaaagactgcttcgaactatcaactaaagatgcagtacgatacaggtggcatgacaaaaacaccgaaagaggcaaaaccttcttcgaaggtgaaagcgtatacgaagagaaagaagagaaagaaattggacaaacaaaacgaggcttagtaaaagaatacgatatcagtaaatgtctaatagggctcttcgaaaaaacgggacttgactataaacagaatctgttagataaaatcaatagtggaaaattcgatggtacattctataaaaatctattcaactatttaaatctactcttcgaaattagaaatagcataagcggaaccgaaatagattatataagctgcccagaatgccaatttcacacagacaaatcaaaaacaatcaaaaacggagacgacaacgggagctataacatagcaagaaaaggcatgataatactagataaaattaagcaattcaaaaaggaaaatggatcactagacaaaatgggctggggagaactgttcatagacttagaagaatgggataaattcgcacaaaaaaagaacaacaatattatcgacaaatga

SEQ ID NO: 9273 - RNA, 4149 nt, synthetic construct
  misc_feature 1..4149: note = Cpf1 variant
  source 1..4149: mol_type = other RNA
atgtcgaaaaataatgtgtgggataaatttacaaatcaatactcattatccaaaacactaagatttgaactaaaaccagtaggaaaaacacgggaaaaaatgaacgaacaactgaaatacgacaaacaattacaaacattcctaaaagaccaggaaatcgaagacgcataccaatatttaaaaccgtttttcgacaaactccataaagaatttattacagacagcctggactccgacacaaccaaaaaaattgacttctcagactatctaatagattatagagataaaaaagatttaacaaaaaaagaggactcactaagaaaaaacataggcgaagtatttgtaaaagcaggagacaggtggaaaaaggagaaatacccgaagtatgaatggaagaaaggcagcaacgtagctaacggttcaggaatactactgacgcaagatgtgctaatgctcattaaagatttaaatcccaacgatcaaaaaatcaagaaaatgatcgaagaaaccttcaagggcttttttacttacttttcaggctttaacttaaatagggaaaactattacacgaccaaagtagaaaaagcaacagcagtagcaacaagaatagtacacgataacttacccaaattttgcgataacctagtacaatttgaatgcatcataaagaaaaaaaaaaacggcgaagtagatcgcatcgaaagaaaaagcgaatacctgaatgcataccagtatttaaaatcaaaaggacgaactactcaaataaaagacgctgaatcggggaaaatgatagaagcagaagttataaacgaaaacatgtttagtataagttacttctcagcttgtttaagtcaatcaggaatagaagaatacaatcggactatcggacactacaacctgttaataaatctatataatcaagcgaaagaaggggaagaaaaggacctaaaaaaatcagaaaaaaaattcaaaagacttccgatattcaaaaccctatacaaacaaattggatgtggagaaaaagaaccactcttcttttcattaacccacgatactaaattacaagttcaagagaacaaagaaaactataagaaaccatatagcgtggaacaaatactagaacaggcaaaattagcaggcgacaaatatttcaaaggaaaatcgaacgacggaatattaaataccattccagaattctcagactacatactgcaaaaggaatcatatggcggcgtatactggtcaaaagttgccattaatacgatctcaaatcgctacttcgaaaattggcatacgttaaaagatgcattaatagacgccaaagtatttgaaaaaggaaaaaagggagatgaagaagacgtcaaaattccagagtcaatagaactacaaggctttttcgatgtattagatacacaggaaggatggaaatcggaaggcatattcttcaaaaaaagcttaaccgaagaacttaaaaataaggaagcagacactaagaacaaaaaaagaagggaaatcgtaaaagaagccaagagaccctcccaagcccttttagcactcttattcgatgacatacaagaacacgcaaacctattcttgaatcaaagcgatgaaatattaaagttagagaagtatagcgaaaaggaatcaaaagaaaaaataaaacaatggatggactcagcattggcagtgaaccgcatattgaaatatttttttgtcaaagaatcaaaggccaagggagaacaaatagatcccataataagcgaggcattaaaagtattattcaattcagaagacgctacgtggttcaaatggtacgatgcacttcgaaactacctcacgaaaaagccacaagatgatgtcaaagaaaataaattaaaactaaacttcgagaattccacattagcgggagggtgggacatcaacaaagagtcggataattactgcgttatacttcaagaccaaaaagggaaacaacacctaggtataattgcaaaaaaggaaaagcaaaggggttataacaaaatattcgaacgaactcctgaaaacccactttacaaaatagattccggagaagtatggcaaaaaatggaatacaaacaaatagcagtcccaaccggaataggaggattcgttcgcaaatgcttcaatacagcacaacaatacgggtggaaatgtccagataattgcctaaactcagaaggtaaaataataataaaaaacgatgaggcaaaggaaaacctagaagcaataatagactgttataaagacttcttcacaaagtatgaaaaagatggattcaaatataaaaactttaactttaactttaaagagtcagaagaatacgaagaacttaactcgtttttttcagacgtcgaacgacaaggatacaaattaggctttataacagtaaacaagacaataatagataaatgggttgaagacggtacaatttaccttttcgaaataaaaaaccaagacacaaatgatggcaaaaaagacggacacaaaaacaacttgcatacaatatactggaaagccttatttgaagatgtaggaaataaaccaaaattaaatggaggagcagagctgttttacagaaaagcgttattaaaagataaacaagaaaaaatcgaagacaattatggaaaagaaatcataaaaaacttcagattctcaaaagaaaagttcctattccactgcccgataaaattaaactataaagcaaagtcatatagtcatccaaaatatgcactccccgagatcaataaacagacaaatgaattctttataactattagtgacatttgttttcttggcatcgacaggggagagaaacatttagcatattacagcctggtaaaccagaaggaagaaatcattgatcaaggtactctaaacatgccatttgttgacaaagacggaaagccaaggtctatcaaaaaagaaaagttccggttcgatgcaaaagtagacaaatgggtctccgaggaaatggactgttggaactataatgatttattagacgcaatggcttcaaatcgagatatggctcgcaaaaactggcaaaccattggaacaattaaagagctaaaaaacggctatatatcccaagtggtgagaaagatagttgacttagcaatcgataagaacagaggaataccaagctttatagtactagaaaacctaaacgcaggatttatgcgaggaaggcaaaaaatagaaaaaagcgtataccaaaaactagaacttgcactcgccaaaaagctaaacttcgtagttgataaaaccgtacaaaacggtgaaataggatcagtgaccaacgctctacaacttactccccctgtcacgaactttcaaaatattgaaaatcgcaaacaagttggaatcatgctgtatactagagctgactacacttcgcaaacagatcccgtaacaggatggagaaaaagcatttatctaaaaaaaggtagtgaagaatacataaaaagccagattatggatagtttcgatgacttcggatttgatggcaaaaactattactttaaatacacagtagatcttatcgatccgatcaaaaaaacaagtgaaaaaaaattcaaaaaacaatggacactttatagcggcattaacggaaagagcctagacagattccggggagagagatcatctgataaaaacgtatggatcaaaaccctacaagacattaaaaccaccttagatgcagtctttataggattcgacctacagcattcactacgatcacaaataatcaacgatggaataatgccgaaaaaaatagagaacagtcaatttacagggtgggaaagcttaagatttgcaatagaaatgatacaacagatcagaaacataggagtcgaaaaaggagacgaagatttcatattatcaccagtaagagacaaaaatgagaaccattttgacagccgcaaagcaaaagaaaacgaaccaaactcgggggacgcaaatggagcctataatattgcgcgaaaaggaattataatgaacgaacacattaaaaaagacctaataccattcatacaagacaaagaatgggatgcctggctcgctggaagggaagtctgggacaagtggcttattgaaaacaaagactcattaatatacaaaaaatga

SEQ ID NO: 9274 - RNA, 4203 nt, synthetic construct
  misc_feature 1..4203: note = Cas9 variant mRNA product
  source 1..4203: mol_type = other RNA
atggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaatga

SEQ ID NO: 9275 - RNA, 4986 nt, synthetic construct
  misc_feature 1..4986: note = Cas9 variant mRNA product
  source 1..4986: mol_type = other RNA
atggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtga

SEQ ID NO: 9276 - RNA, 3258 nt, synthetic construct
  misc_feature 1..3258: note = Cas9 variant mRNA product
  source 1..3258: mol_type = other RNA
atggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaatga

SEQ ID NO: 9277 - RNA, 4326 nt, synthetic construct
  misc_feature 1..4326: note = Cas9 variant mRNA product
  source 1..4326: mol_type = other RNA
atggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaatga

SEQ ID NO: 9278 - RNA, 3402 nt, synthetic construct
  misc_feature 1..3402: note = Cas9 variant mRNA product
  source 1..3402: mol_type = other RNA
atggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaatga

SEQ ID NO: 9279 - RNA, 4263 nt, synthetic construct
  misc_feature 1..4263: note = Cas9 variant mRNA product
  source 1..4263: mol_type = other RNA
atggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaatga

SEQ ID NO: 9280 - RNA, 3345 nt, synthetic construct
  misc_feature 1..3345: note = Cas9 variant mRNA product
  source 1..3345: mol_type = other RNA
atggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaatga

SEQ ID NO: 9281 - RNA, 4101 nt, synthetic construct
  misc_feature 1..4101: note = Cas9 variant mRNA product
  source 1..4101: mol_type = other RNA
atggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaatga

SEQ ID NO: 9282 - RNA, 4134 nt, synthetic construct
  misc_feature 1..4134: note = Cas9 variant mRNA product
  source 1..4134: mol_type = other RNA
atggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaatga

SEQ ID NO: 9283 - RNA, 3267 nt, synthetic construct
  misc_feature 1..3267: note = Cas9 variant mRNA product
  source 1..3267: mol_type = other RNA
atggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaatga

SEQ ID NO: 9284 - RNA, 3345 nt, synthetic construct
  misc_feature 1..3345: note = Cas9 variant mRNA product
  source 1..3345: mol_type = other RNA
atggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaatga

SEQ ID NO: 9285 - RNA, 3351 nt, synthetic construct
  misc_feature 1..3351: note = Cas9 variant mRNA product
  source 1..3351: mol_type = other RNA
atggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaatga

SEQ ID NO: 9286 - RNA, 3051 nt, synthetic construct
  misc_feature 1..3051: note = Cas9 variant mRNA product
  source 1..3051: mol_type = other RNA
atggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaatga

SEQ ID NO: 9287 - RNA, 3462 nt, synthetic construct
  misc_feature 1..3462: note = Cas9 variant mRNA product
  source 1..3462: mol_type = other RNA
atggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaatga

SEQ ID NO: 9288 - RNA, 4020 nt, synthetic construct
  misc_feature 1..4020: note = Cpf1 variant mRNA product
  source 1..4020: mol_type = other RNA
atggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaatga

SEQ ID NO: 9289 - RNA, 3999 nt, synthetic construct
  misc_feature 1..3999: note = Cpf1 variant mRNA product
  source 1..3999: mol_type = other RNA
atggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaatga

SEQ ID NO: 9290 - RNA, 4716 nt, synthetic construct
  misc_feature 1..4716: note = Cas9 variant mRNA product
  source 1..4716: mol_type = other RNA
gggagagtcccgcagtcggcgtccagcggctctgcttgttcgtgtgtgtgtcgttgcaggccttattcaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9291 - RNA, 5499 nt, synthetic construct
  misc_feature 1..5499: note = Cas9 variant mRNA product
  source 1..5499: mol_type = other RNA
gggagagtcccgcagtcggcgtccagcggctctgcttgttcgtgtgtgtgtcgttgcaggccttattcaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9292 - RNA, 3771 nt, synthetic construct
  misc_feature 1..3771: note = Cas9 variant mRNA product
  source 1..3771: mol_type = other RNA
gggagagtcccgcagtcggcgtccagcggctctgcttgttcgtgtgtgtgtcgttgcaggccttattcaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9293 - RNA, 4839 nt, synthetic construct
  misc_feature 1..4839: note = Cas9 variant mRNA product
  source 1..4839: mol_type = other RNA
gggagagtcccgcagtcggcgtccagcggctctgcttgttcgtgtgtgtgtcgttgcaggccttattcaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9294 - RNA, 3915 nt, synthetic construct
  misc_feature 1..3915: note = Cas9 variant mRNA product
  source 1..3915: mol_type = other RNA
gggagagtcccgcagtcggcgtccagcggctctgcttgttcgtgtgtgtgtcgttgcaggccttattcaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9295 - RNA, 4776 nt, synthetic construct
  misc_feature 1..4776: note = Cas9 variant mRNA product
  source 1..4776: mol_type = other RNA
gggagagtcccgcagtcggcgtccagcggctctgcttgttcgtgtgtgtgtcgttgcaggccttattcaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9296 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9297 - RNA, 4614 nt, synthetic construct
  misc_feature 1..4614: note = Cas9 variant mRNA product
  source 1..4614: mol_type = other RNA
gggagagtcccgcagtcggcgtccagcggctctgcttgttcgtgtgtgtgtcgttgcaggccttattcaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9298 - RNA, 4647 nt, synthetic construct
  misc_feature 1..4647: note = Cas9 variant mRNA product
  source 1..4647: mol_type = other RNA
gggagagtcccgcagtcggcgtccagcggctctgcttgttcgtgtgtgtgtcgttgcaggccttattcaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9299 - RNA, 3780 nt, synthetic construct
  misc_feature 1..3780: note = Cas9 variant mRNA product
  source 1..3780: mol_type = other RNA
gggagagtcccgcagtcggcgtccagcggctctgcttgttcgtgtgtgtgtcgttgcaggccttattcaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9300 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9301 - RNA, 3864 nt, synthetic construct
  misc_feature 1..3864: note = Cas9 variant mRNA product
  source 1..3864: mol_type = other RNA
gggagagtcccgcagtcggcgtccagcggctctgcttgttcgtgtgtgtgtcgttgcaggccttattcaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9302 - RNA, 3564 nt, synthetic construct
  misc_feature 1..3564: note = Cas9 variant mRNA product
  source 1..3564: mol_type = other RNA
gggagagtcccgcagtcggcgtccagcggctctgcttgttcgtgtgtgtgtcgttgcaggccttattcaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9303 - RNA, 3975 nt, synthetic construct
  misc_feature 1..3975: note = Cas9 variant mRNA product
  source 1..3975: mol_type = other RNA
gggagagtcccgcagtcggcgtccagcggctctgcttgttcgtgtgtgtgtcgttgcaggccttattcaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9304 - RNA, 4533 nt, synthetic construct
  misc_feature 1..4533: note = Cpf1 variant mRNA product
  source 1..4533: mol_type = other RNA
gggagagtcccgcagtcggcgtccagcggctctgcttgttcgtgtgtgtgtcgttgcaggccttattcaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9305 - RNA, 4512 nt, synthetic construct
  misc_feature 1..4512: note = Cpf1 variant mRNA product
  source 1..4512: mol_type = other RNA
gggagagtcccgcagtcggcgtccagcggctctgcttgttcgtgtgtgtgtcgttgcaggccttattcaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9306 - RNA, 4813 nt, synthetic construct
  misc_feature 1..4813: note = Cas9 variant mRNA product
  source 1..4813: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9307 - RNA, 5596 nt, synthetic construct
  misc_feature 1..5596: note = Cas9 variant mRNA product
  source 1..5596: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9308 - RNA, 3868 nt, synthetic construct
  misc_feature 1..3868: note = Cas9 variant mRNA product
  source 1..3868: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9309 - RNA, 4936 nt, synthetic construct
  misc_feature 1..4936: note = Cas9 variant mRNA product
  source 1..4936: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9310 - RNA, 4012 nt, synthetic construct
  misc_feature 1..4012: note = Cas9 variant mRNA product
  source 1..4012: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9311 - RNA, 4873 nt, synthetic construct
  misc_feature 1..4873: note = Cas9 variant mRNA product
  source 1..4873: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9312 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9313 - RNA, 4711 nt, synthetic construct
  misc_feature 1..4711: note = Cas9 variant mRNA product
  source 1..4711: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9314 - RNA, 4744 nt, synthetic construct
  misc_feature 1..4744: note = Cas9 variant mRNA product
  source 1..4744: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9315 - RNA, 3877 nt, synthetic construct
  misc_feature 1..3877: note = Cas9 variant mRNA product
  source 1..3877: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9316 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9317 - RNA, 3961 nt, synthetic construct
  misc_feature 1..3961: note = Cas9 variant mRNA product
  source 1..3961: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9318 - RNA, 3661 nt, synthetic construct
  misc_feature 1..3661: note = Cas9 variant mRNA product
  source 1..3661: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9319 - RNA, 4072 nt, synthetic construct
  misc_feature 1..4072: note = Cas9 variant mRNA product
  source 1..4072: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9320 - RNA, 4630 nt, synthetic construct
  misc_feature 1..4630: note = Cpf1 variant mRNA product
  source 1..4630: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9321 - RNA, 4609 nt, synthetic construct
  misc_feature 1..4609: note = Cpf1 variant mRNA product
  source 1..4609: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9322 - RNA, 4497 nt, synthetic construct
  misc_feature 1..4497: note = Cas9 variant mRNA product
  source 1..4497: mol_type = other RNA
gggagagcggctcggccattttgtcccagtcagtccggaggctgcggctgcagaagtaccgcctgcggagtaactgcaaagaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9323 - RNA, 5280 nt, synthetic construct
  misc_feature 1..5280: note = Cas9 variant mRNA product
  source 1..5280: mol_type = other RNA
gggagagcggctcggccattttgtcccagtcagtccggaggctgcggctgcagaagtaccgcctgcggagtaactgcaaagaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9324 - RNA, 3552 nt, synthetic construct
  misc_feature 1..3552: note = Cas9 variant mRNA product
  source 1..3552: mol_type = other RNA
gggagagcggctcggccattttgtcccagtcagtccggaggctgcggctgcagaagtaccgcctgcggagtaactgcaaagaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9325 - RNA, 4620 nt, synthetic construct
  misc_feature 1..4620: note = Cas9 variant mRNA product
  source 1..4620: mol_type = other RNA
gggagagcggctcggccattttgtcccagtcagtccggaggctgcggctgcagaagtaccgcctgcggagtaactgcaaagaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9326 - RNA, 3696 nt, synthetic construct
  misc_feature 1..3696: note = Cas9 variant mRNA product
  source 1..3696: mol_type = other RNA
gggagagcggctcggccattttgtcccagtcagtccggaggctgcggctgcagaagtaccgcctgcggagtaactgcaaagaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9327 - RNA, 4557 nt, synthetic construct
  misc_feature 1..4557: note = Cas9 variant mRNA product
  source 1..4557: mol_type = other RNA
gggagagcggctcggccattttgtcccagtcagtccggaggctgcggctgcagaagtaccgcctgcggagtaactgcaaagaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9328 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9329 - RNA, 4395 nt, synthetic construct
  misc_feature 1..4395: note = Cas9 variant mRNA product
  source 1..4395: mol_type = other RNA
gggagagcggctcggccattttgtcccagtcagtccggaggctgcggctgcagaagtaccgcctgcggagtaactgcaaagaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9330 - RNA, 4428 nt, synthetic construct
  misc_feature 1..4428: note = Cas9 variant mRNA product
  source 1..4428: mol_type = other RNA
gggagagcggctcggccattttgtcccagtcagtccggaggctgcggctgcagaagtaccgcctgcggagtaactgcaaagaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9331 - RNA, 3561 nt, synthetic construct
  misc_feature 1..3561: note = Cas9 variant mRNA product
  source 1..3561: mol_type = other RNA
gggagagcggctcggccattttgtcccagtcagtccggaggctgcggctgcagaagtaccgcctgcggagtaactgcaaagaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9332 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9333 - RNA, 3645 nt, synthetic construct
  misc_feature 1..3645: note = Cas9 variant mRNA product
  source 1..3645: mol_type = other RNA
gggagagcggctcggccattttgtcccagtcagtccggaggctgcggctgcagaagtaccgcctgcggagtaactgcaaagaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9334 - RNA, 3345 nt, synthetic construct
  misc_feature 1..3345: note = Cas9 variant mRNA product
  source 1..3345: mol_type = other RNA
gggagagcggctcggccattttgtcccagtcagtccggaggctgcggctgcagaagtaccgcctgcggagtaactgcaaagaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9335 - RNA, 3756 nt, synthetic construct
  misc_feature 1..3756: note = Cas9 variant mRNA product
  source 1..3756: mol_type = other RNA
gggagagcggctcggccattttgtcccagtcagtccggaggctgcggctgcagaagtaccgcctgcggagtaactgcaaagaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9336 - RNA, 4314 nt, synthetic construct
  misc_feature 1..4314: note = Cpf1 variant mRNA product
  source 1..4314: mol_type = other RNA
gggagagcggctcggccattttgtcccagtcagtccggaggctgcggctgcagaagtaccgcctgcggagtaactgcaaagaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9337 - RNA, 4293 nt, synthetic construct
  misc_feature 1..4293: note = Cpf1 variant mRNA product
  source 1..4293: mol_type = other RNA
gggagagcggctcggccattttgtcccagtcagtccggaggctgcggctgcagaagtaccgcctgcggagtaactgcaaagaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9338 - RNA, 4439 nt, synthetic construct
  misc_feature 1..4439: note = Cas9 variant mRNA product
  source 1..4439: mol_type = other RNA
gggagagtccgctcagccaggttgcagaagcggcttagcgtgtgtcctaatcttctctctgcgtgtaggtaggcctgtgccgcaaacaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9339 - RNA, 5222 nt, synthetic construct
  misc_feature 1..5222: note = Cas9 variant mRNA product
  source 1..5222: mol_type = other RNA
gggagagtccgctcagccaggttgcagaagcggcttagcgtgtgtcctaatcttctctctgcgtgtaggtaggcctgtgccgcaaacaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9340 - RNA, 3494 nt, synthetic construct
  misc_feature 1..3494: note = Cas9 variant mRNA product
  source 1..3494: mol_type = other RNA
gggagagtccgctcagccaggttgcagaagcggcttagcgtgtgtcctaatcttctctctgcgtgtaggtaggcctgtgccgcaaacaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9341 - RNA, 4562 nt, synthetic construct
  misc_feature 1..4562: note = Cas9 variant mRNA product
  source 1..4562: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9342 - RNA, 3638 nt, synthetic construct
  misc_feature 1..3638: note = Cas9 variant mRNA product
  source 1..3638: mol_type = other RNA
gggagagtccgctcagccaggttgcagaagcggcttagcgtgtgtcctaatcttctctctgcgtgtaggtaggcctgtgccgcaaacaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9343 - RNA, 4499 nt, synthetic construct
  misc_feature 1..4499: note = Cas9 variant mRNA product
  source 1..4499: mol_type = other RNA
gggagagtccgctcagccaggttgcagaagcggcttagcgtgtgtcctaatcttctctctgcgtgtaggtaggcctgtgccgcaaacaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9344 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9345 - RNA, 4337 nt, synthetic construct
  misc_feature 1..4337: note = Cas9 variant mRNA product
  source 1..4337: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9346 - RNA, 4370 nt, synthetic construct
  misc_feature 1..4370: note = Cas9 variant mRNA product
  source 1..4370: mol_type = other RNA
gggagagtccgctcagccaggttgcagaagcggcttagcgtgtgtcctaatcttctctctgcgtgtaggtaggcctgtgccgcaaacaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9347 - RNA, 3503 nt, synthetic construct
  misc_feature 1..3503: note = Cas9 variant mRNA product
  source 1..3503: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9348 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9349 - RNA, 3587 nt, synthetic construct
  misc_feature 1..3587: note = Cas9 variant mRNA product
  source 1..3587: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9350 - RNA, 3287 nt, synthetic construct
  misc_feature 1..3287: note = Cas9 variant mRNA product
  source 1..3287: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9351 - RNA, 3698 nt, synthetic construct
  misc_feature 1..3698: note = Cas9 variant mRNA product
  source 1..3698: mol_type = other RNA
gggagagtccgctcagccaggttgcagaagcggcttagcgtgtgtcctaatcttctctctgcgtgtaggtaggcctgtgccgcaaacaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9352 - RNA, 4256 nt, synthetic construct
  misc_feature 1..4256: note = Cpf1 variant mRNA product
  source 1..4256: mol_type = other RNA
gggagagtccgctcagccaggttgcagaagcggcttagcgtgtgtcctaatcttctctctgcgtgtaggtaggcctgtgccgcaaacaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9353 - RNA, 4235 nt, synthetic construct
  misc_feature 1..4235: note = Cpf1 variant mRNA product
  source 1..4235: mol_type = other RNA
gggagagtccgctcagccaggttgcagaagcggcttagcgtgtgtcctaatcttctctctgcgtgtaggtaggcctgtgccgcaaacaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9354 - RNA, 4420 nt, synthetic construct
  misc_feature 1..4420: note = Cas9 variant mRNA product
  source 1..4420: mol_type = other RNA
gggagagtcccgcagtcggcgtccagcggctctgcttgttcgtgtgtgtgtcgttgcaggccttattcaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9355 - RNA, 5203 nt, synthetic construct
  misc_feature 1..5203: note = Cas9 variant mRNA product
  source 1..5203: mol_type = other RNA
gggagagtcccgcagtcggcgtccagcggctctgcttgttcgtgtgtgtgtcgttgcaggccttattcaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9356 - RNA, 3475 nt, synthetic construct
  misc_feature 1..3475: note = Cas9 variant mRNA product
  source 1..3475: mol_type = other RNA
gggagagtcccgcagtcggcgtccagcggctctgcttgttcgtgtgtgtgtcgttgcaggccttattcaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9357 - RNA, 4543 nt, synthetic construct
  misc_feature 1..4543: note = Cas9 variant mRNA product
  source 1..4543: mol_type = other RNA
gggagagtcccgcagtcggcgtccagcggctctgcttgttcgtgtgtgtgtcgttgcaggccttattcaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9358 - RNA, 3619 nt, synthetic construct
  misc_feature 1..3619: note = Cas9 variant mRNA product
  source 1..3619: mol_type = other RNA
gggagagtcccgcagtcggcgtccagcggctctgcttgttcgtgtgtgtgtcgttgcaggccttattcaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9359 - RNA, 4480 nt, synthetic construct
  misc_feature 1..4480: note = Cas9 variant mRNA product
  source 1..4480: mol_type = other RNA
gggagagtcccgcagtcggcgtccagcggctctgcttgttcgtgtgtgtgtcgttgcaggccttattcaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9360 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9361 - RNA, 4318 nt, synthetic construct
  misc_feature 1..4318: note = Cas9 variant mRNA product
  source 1..4318: mol_type = other RNA
gggagagtcccgcagtcggcgtccagcggctctgcttgttcgtgtgtgtgtcgttgcaggccttattcaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9362 - RNA, 4351 nt, synthetic construct
  misc_feature 1..4351: note = Cas9 variant mRNA product
  source 1..4351: mol_type = other RNA
gggagagtcccgcagtcggcgtccagcggctctgcttgttcgtgtgtgtgtcgttgcaggccttattcaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9363 - RNA, 3484 nt, synthetic construct
  misc_feature 1..3484: note = Cas9 variant mRNA product
  source 1..3484: mol_type = other RNA
gggagagtcccgcagtcggcgtccagcggctctgcttgttcgtgtgtgtgtcgttgcaggccttattcaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9364 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9365 - RNA, 3568 nt, synthetic construct
  misc_feature 1..3568: note = Cas9 variant mRNA product
  source 1..3568: mol_type = other RNA
gggagagtcccgcagtcggcgtccagcggctctgcttgttcgtgtgtgtgtcgttgcaggccttattcaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9366 - RNA, 3268 nt, synthetic construct
  misc_feature 1..3268: note = Cas9 variant mRNA product
  source 1..3268: mol_type = other RNA
gggagagtcccgcagtcggcgtccagcggctctgcttgttcgtgtgtgtgtcgttgcaggccttattcaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9367 - RNA, 3679 nt, synthetic construct
  misc_feature 1..3679: note = Cas9 variant mRNA product
  source 1..3679: mol_type = other RNA
gggagagtcccgcagtcggcgtccagcggctctgcttgttcgtgtgtgtgtcgttgcaggccttattcaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9368 - RNA, 4237 nt, synthetic construct
  misc_feature 1..4237: note = Cpf1 variant mRNA product
  source 1..4237: mol_type = other RNA
gggagagtcccgcagtcggcgtccagcggctctgcttgttcgtgtgtgtgtcgttgcaggccttattcaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9369 - RNA, 4216 nt, synthetic construct
  misc_feature 1..4216: note = Cpf1 variant mRNA product
  source 1..4216: mol_type = other RNA
gggagagtcccgcagtcggcgtccagcggctctgcttgttcgtgtgtgtgtcgttgcaggccttattcaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9370 - RNA, 4530 nt, synthetic construct
  misc_feature 1..4530: note = Cas9 variant mRNA product
  source 1..4530: mol_type = other RNA
gggagaggcgctgcctacggaggtggcagccatctccttctcggcatcaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9371 - RNA, 5313 nt, synthetic construct
  misc_feature 1..5313: note = Cas9 variant mRNA product
  source 1..5313: mol_type = other RNA
gggagaggcgctgcctacggaggtggcagccatctccttctcggcatcaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9372 - RNA, 3585 nt, synthetic construct
  misc_feature 1..3585: note = Cas9 variant mRNA product
  source 1..3585: mol_type = other RNA
gggagaggcgctgcctacggaggtggcagccatctccttctcggcatcaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9373 - RNA, 4653 nt, synthetic construct
  misc_feature 1..4653: note = Cas9 variant mRNA product
  source 1..4653: mol_type = other RNA
gggagaggcgctgcctacggaggtggcagccatctccttctcggcatcaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9374 - RNA, 3729 nt, synthetic construct
  misc_feature 1..3729: note = Cas9 variant mRNA product
  source 1..3729: mol_type = other RNA
gggagaggcgctgcctacggaggtggcagccatctccttctcggcatcaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9375 - RNA, 4590 nt, synthetic construct
  misc_feature 1..4590: note = Cas9 variant mRNA product
  source 1..4590: mol_type = other RNA
gggagaggcgctgcctacggaggtggcagccatctccttctcggcatcaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9376 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9377 - RNA, 4428 nt, synthetic construct
  misc_feature 1..4428: note = Cas9 variant mRNA product
  source 1..4428: mol_type = other RNA
gggagaggcgctgcctacggaggtggcagccatctccttctcggcatcaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9378 - RNA, 4461 nt, synthetic construct
  misc_feature 1..4461: note = Cas9 variant mRNA product
  source 1..4461: mol_type = other RNA
gggagaggcgctgcctacggaggtggcagccatctccttctcggcatcaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9379 - RNA, 3594 nt, synthetic construct
  misc_feature 1..3594: note = Cas9 variant mRNA product
  source 1..3594: mol_type = other RNA
gggagaggcgctgcctacggaggtggcagccatctccttctcggcatcaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9380 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9381 - RNA, 3678 nt, synthetic construct
  misc_feature 1..3678: note = Cas9 variant mRNA product
  source 1..3678: mol_type = other RNA
gggagaggcgctgcctacggaggtggcagccatctccttctcggcatcaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9382 - RNA, 3378 nt, synthetic construct
  misc_feature 1..3378: note = Cas9 variant mRNA product
  source 1..3378: mol_type = other RNA
gggagaggcgctgcctacggaggtggcagccatctccttctcggcatcaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9383 - RNA, 3789 nt, synthetic construct
  misc_feature 1..3789: note = Cas9 variant mRNA product
  source 1..3789: mol_type = other RNA
gggagaggcgctgcctacggaggtggcagccatctccttctcggcatcaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9384 - RNA, 4347 nt, synthetic construct
  misc_feature 1..4347: note = Cpf1 variant mRNA product
  source 1..4347: mol_type = other RNA
gggagaggcgctgcctacggaggtggcagccatctccttctcggcatcaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9385 - RNA, 4326 nt, synthetic construct
  misc_feature 1..4326: note = Cpf1 variant mRNA product
  source 1..4326: mol_type = other RNA
gggagaggcgctgcctacggaggtggcagccatctccttctcggcatcaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 9386 - RNA, 4582 nt, synthetic construct
  misc_feature 1..4582: note = Cas9 variant mRNA product
  source 1..4582: mol_type = other RNA
ggggcgctgcctacggaggtggcagccatctccttctcggcatcaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9387 - RNA, 5365 nt, synthetic construct
  misc_feature 1..5365: note = Cas9 variant mRNA product
  source 1..5365: mol_type = other RNA
ggggcgctgcctacggaggtggcagccatctccttctcggcatcaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9388 - RNA, 3637 nt, synthetic construct
  misc_feature 1..3637: note = Cas9 variant mRNA product
  source 1..3637: mol_type = other RNA
ggggcgctgcctacggaggtggcagccatctccttctcggcatcaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9389 - RNA, 4705 nt, synthetic construct
  misc_feature 1..4705: note = Cas9 variant mRNA product
  source 1..4705: mol_type = other RNA
ggggcgctgcctacggaggtggcagccatctccttctcggcatcaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9390 - RNA, 3781 nt, synthetic construct
  misc_feature 1..3781: note = Cas9 variant mRNA product
  source 1..3781: mol_type = other RNA
ggggcgctgcctacggaggtggcagccatctccttctcggcatcaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9391 - RNA, 4642 nt, synthetic construct
  misc_feature 1..4642: note = Cas9 variant mRNA product
  source 1..4642: mol_type = other RNA
ggggcgctgcctacggaggtggcagccatctccttctcggcatcaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9392 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9393 - RNA, 4480 nt, synthetic construct
  misc_feature 1..4480: note = Cas9 variant mRNA product
  source 1..4480: mol_type = other RNA
ggggcgctgcctacggaggtggcagccatctccttctcggcatcaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9394 - RNA, 4513 nt, synthetic construct
  misc_feature 1..4513: note = Cas9 variant mRNA product
  source 1..4513: mol_type = other RNA
ggggcgctgcctacggaggtggcagccatctccttctcggcatcaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9395 - RNA, 3646 nt, synthetic construct
  misc_feature 1..3646: note = Cas9 variant mRNA product
  source 1..3646: mol_type = other RNA
ggggcgctgcctacggaggtggcagccatctccttctcggcatcaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9396 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9397 - RNA, 3730 nt, synthetic construct
  misc_feature 1..3730: note = Cas9 variant mRNA product
  source 1..3730: mol_type = other RNA
ggggcgctgcctacggaggtggcagccatctccttctcggcatcaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9398 - RNA, 3430 nt, synthetic construct
  misc_feature 1..3430: note = Cas9 variant mRNA product
  source 1..3430: mol_type = other RNA
ggggcgctgcctacggaggtggcagccatctccttctcggcatcaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9399 - RNA, 3841 nt, synthetic construct
  misc_feature 1..3841: note = Cas9 variant mRNA product
  source 1..3841: mol_type = other RNA
ggggcgctgcctacggaggtggcagccatctccttctcggcatcaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9400 - RNA, 4399 nt, synthetic construct
  misc_feature 1..4399: note = Cpf1 variant mRNA product
  source 1..4399: mol_type = other RNA
ggggcgctgcctacggaggtggcagccatctccttctcggcatcaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9401 - RNA, 4378 nt, synthetic construct
  misc_feature 1..4378: note = Cpf1 variant mRNA product
  source 1..4378: mol_type = other RNA
ggggcgctgcctacggaggtggcagccatctccttctcggcatcaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 9402 - RNA, 4484 nt, synthetic construct
  misc_feature 1..4484: note = Cas9 variant mRNA product
  source 1..4484: mol_type = other RNA
gggagagtcccgcagtcggcgtccagcggctctgcttgttcgtgtgtgtgtcgttgcaggccttattcaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9403 - RNA, 5267 nt, synthetic construct
  misc_feature 1..5267: note = Cas9 variant mRNA product
  source 1..5267: mol_type = other RNA
gggagagtcccgcagtcggcgtccagcggctctgcttgttcgtgtgtgtgtcgttgcaggccttattcaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9404 - RNA, 3539 nt, synthetic construct
  misc_feature 1..3539: note = Cas9 variant mRNA product
  source 1..3539: mol_type = other RNA
gggagagtcccgcagtcggcgtccagcggctctgcttgttcgtgtgtgtgtcgttgcaggccttattcaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9405 - RNA, 4607 nt, synthetic construct
  misc_feature 1..4607: note = Cas9 variant mRNA product
  source 1..4607: mol_type = other RNA
gggagagtcccgcagtcggcgtccagcggctctgcttgttcgtgtgtgtgtcgttgcaggccttattcaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9406 - RNA, 3683 nt, synthetic construct
  misc_feature 1..3683: note = Cas9 variant mRNA product
  source 1..3683: mol_type = other RNA
gggagagtcccgcagtcggcgtccagcggctctgcttgttcgtgtgtgtgtcgttgcaggccttattcaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9407 - RNA, 4544 nt, synthetic construct
  misc_feature 1..4544: note = Cas9 variant mRNA product
  source 1..4544: mol_type = other RNA
gggagagtcccgcagtcggcgtccagcggctctgcttgttcgtgtgtgtgtcgttgcaggccttattcaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9408 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9409 - RNA, 4382 nt, synthetic construct
  misc_feature 1..4382: note = Cas9 variant mRNA product
  source 1..4382: mol_type = other RNA
gggagagtcccgcagtcggcgtccagcggctctgcttgttcgtgtgtgtgtcgttgcaggccttattcaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9410 - RNA, 4415 nt, synthetic construct
  misc_feature 1..4415: note = Cas9 variant mRNA product
  source 1..4415: mol_type = other RNA
gggagagtcccgcagtcggcgtccagcggctctgcttgttcgtgtgtgtgtcgttgcaggccttattcaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9411 - RNA, 3548 nt, synthetic construct
  misc_feature 1..3548: note = Cas9 variant mRNA product
  source 1..3548: mol_type = other RNA
gggagagtcccgcagtcggcgtccagcggctctgcttgttcgtgtgtgtgtcgttgcaggccttattcaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9412 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9413 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9414 - RNA, 3332 nt, synthetic construct
  misc_feature 1..3332: note = Cas9 variant mRNA product
  source 1..3332: mol_type = other RNA
gggagagtcccgcagtcggcgtccagcggctctgcttgttcgtgtgtgtgtcgttgcaggccttattcaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9415 - RNA, 3743 nt, synthetic construct
  misc_feature 1..3743: note = Cas9 variant mRNA product
  source 1..3743: mol_type = other RNA
gggagagtcccgcagtcggcgtccagcggctctgcttgttcgtgtgtgtgtcgttgcaggccttattcaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9416 - RNA, 4301 nt, synthetic construct
  misc_feature 1..4301: note = Cpf1 variant mRNA product
  source 1..4301: mol_type = other RNA
gggagagtcccgcagtcggcgtccagcggctctgcttgttcgtgtgtgtgtcgttgcaggccttattcaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9417 - RNA, 4280 nt, synthetic construct
  misc_feature 1..4280: note = Cpf1 variant mRNA product
  source 1..4280: mol_type = other RNA
gggagagtcccgcagtcggcgtccagcggctctgcttgttcgtgtgtgtgtcgttgcaggccttattcaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9418 - RNA, 4581 nt, synthetic construct
  misc_feature 1..4581: note = Cas9 variant mRNA product
  source 1..4581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9419 - RNA, 5364 nt, synthetic construct
  misc_feature 1..5364: note = Cas9 variant mRNA product
  source 1..5364: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9420 - RNA, 3636 nt, synthetic construct
  misc_feature 1..3636: note = Cas9 variant mRNA product
  source 1..3636: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9421 - RNA, 4704 nt, synthetic construct
  misc_feature 1..4704: note = Cas9 variant mRNA product
  source 1..4704: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9422 - RNA, 3780 nt, synthetic construct
  misc_feature 1..3780: note = Cas9 variant mRNA product
  source 1..3780: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9423 - RNA, 4641 nt, synthetic construct
  misc_feature 1..4641: note = Cas9 variant mRNA product
  source 1..4641: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9424 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9425 - RNA, 4479 nt, synthetic construct
  misc_feature 1..4479: note = Cas9 variant mRNA product
  source 1..4479: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9426 - RNA, 4512 nt, synthetic construct
  misc_feature 1..4512: note = Cas9 variant mRNA product
  source 1..4512: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9427 - RNA, 3645 nt, synthetic construct
  misc_feature 1..3645: note = Cas9 variant mRNA product
  source 1..3645: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9428 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9429 - RNA, 3729 nt, synthetic construct
  misc_feature 1..3729: note = Cas9 variant mRNA product
  source 1..3729: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9430 - RNA, 3429 nt, synthetic construct
  misc_feature 1..3429: note = Cas9 variant mRNA product
  source 1..3429: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9431 - RNA, 3840 nt, synthetic construct
  misc_feature 1..3840: note = Cas9 variant mRNA product
  source 1..3840: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9432 - RNA, 4398 nt, synthetic construct
  misc_feature 1..4398: note = Cpf1 variant mRNA product
  source 1..4398: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9433 - RNA, 4377 nt, synthetic construct
  misc_feature 1..4377: note = Cpf1 variant mRNA product
  source 1..4377: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 9434 - RNA, 4517 nt, synthetic construct
  misc_feature 1..4517: note = Cas9 variant mRNA product
  source 1..4517: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9435 - RNA, 5300 nt, synthetic construct
  misc_feature 1..5300: note = Cas9 variant mRNA product
  source 1..5300: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9436 - RNA, 3572 nt, synthetic construct
  misc_feature 1..3572: note = Cas9 variant mRNA product
  source 1..3572: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9437 - RNA, 4640 nt, synthetic construct
  misc_feature 1..4640: note = Cas9 variant mRNA product
  source 1..4640: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9438 - RNA, 3716 nt, synthetic construct
  misc_feature 1..3716: note = Cas9 variant mRNA product
  source 1..3716: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9439 - RNA, 4577 nt, synthetic construct
  misc_feature 1..4577: note = Cas9 variant mRNA product
  source 1..4577: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9440 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9441 - RNA, 4415 nt, synthetic construct
  misc_feature 1..4415: note = Cas9 variant mRNA product
  source 1..4415: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9442 - RNA, 4448 nt, synthetic construct
  misc_feature 1..4448: note = Cas9 variant mRNA product
  source 1..4448: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9443 - RNA, 3581 nt, synthetic construct
  misc_feature 1..3581: note = Cas9 variant mRNA product
  source 1..3581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9444 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9445 - RNA, 3665 nt, synthetic construct
  misc_feature 1..3665: note = Cas9 variant mRNA product
  source 1..3665: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9446 - RNA, 3365 nt, synthetic construct
  misc_feature 1..3365: note = Cas9 variant mRNA product
  source 1..3365: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9447 - RNA, 3776 nt, synthetic construct
  misc_feature 1..3776: note = Cas9 variant mRNA product
  source 1..3776: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9448 - RNA, 4334 nt, synthetic construct
  misc_feature 1..4334: note = Cpf1 variant mRNA product
  source 1..4334: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9449 - RNA, 4313 nt, synthetic construct
  misc_feature 1..4313: note = Cpf1 variant mRNA product
  source 1..4313: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9450 - RNA, 4466 nt, synthetic construct
  misc_feature 1..4466: note = Cas9 variant mRNA product
  source 1..4466: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9451 - RNA, 5249 nt, synthetic construct
  misc_feature 1..5249: note = Cas9 variant mRNA product
  source 1..5249: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9452 - RNA, 3521 nt, synthetic construct
  misc_feature 1..3521: note = Cas9 variant mRNA product
  source 1..3521: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9453 - RNA, 4589 nt, synthetic construct
  misc_feature 1..4589: note = Cas9 variant mRNA product
  source 1..4589: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9454 - RNA, 3665 nt, synthetic construct
  misc_feature 1..3665: note = Cas9 variant mRNA product
  source 1..3665: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9455 - RNA, 4526 nt, synthetic construct
  misc_feature 1..4526: note = Cas9 variant mRNA product
  source 1..4526: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9456 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9457 - RNA, 4364 nt, synthetic construct
  misc_feature 1..4364: note = Cas9 variant mRNA product
  source 1..4364: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9458 - RNA, 4397 nt, synthetic construct
  misc_feature 1..4397: note = Cas9 variant mRNA product
  source 1..4397: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9459 - RNA, 3530 nt, synthetic construct
  misc_feature 1..3530: note = Cas9 variant mRNA product
  source 1..3530: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9460 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9461 - RNA, 3614 nt, synthetic construct
  misc_feature 1..3614: note = Cas9 variant mRNA product
  source 1..3614: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9462 - RNA, 3314 nt, synthetic construct
  misc_feature 1..3314: note = Cas9 variant mRNA product
  source 1..3314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9463 - RNA, 3725 nt, synthetic construct
  misc_feature 1..3725: note = Cas9 variant mRNA product
  source 1..3725: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9464 - RNA, 4283 nt, synthetic construct
  misc_feature 1..4283: note = Cpf1 variant mRNA product
  source 1..4283: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9465 - RNA, 4262 nt, synthetic construct
  misc_feature 1..4262: note = Cpf1 variant mRNA product
  source 1..4262: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 9466 - RNA, 4452 nt, synthetic construct
  misc_feature 1..4452: note = Cas9 variant mRNA product
  source 1..4452: mol_type = other RNA
gggagagtccgctcagccaggttgcagaagcggcttagcgtgtgtcctaatcttctctctgcgtgtaggtaggcctgtgccgcaaacaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9467 - RNA, 5235 nt, synthetic construct
  misc_feature 1..5235: note = Cas9 variant mRNA product
  source 1..5235: mol_type = other RNA
gggagagtccgctcagccaggttgcagaagcggcttagcgtgtgtcctaatcttctctctgcgtgtaggtaggcctgtgccgcaaacaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9468 - RNA, 3507 nt, synthetic construct
  misc_feature 1..3507: note = Cas9 variant mRNA product
  source 1..3507: mol_type = other RNA
gggagagtccgctcagccaggttgcagaagcggcttagcgtgtgtcctaatcttctctctgcgtgtaggtaggcctgtgccgcaaacaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9469 - RNA, 4575 nt, synthetic construct
  misc_feature 1..4575: note = Cas9 variant mRNA product
  source 1..4575: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9470 - RNA, 3651 nt, synthetic construct
  misc_feature 1..3651: note = Cas9 variant mRNA product
  source 1..3651: mol_type = other RNA
gggagagtccgctcagccaggttgcagaagcggcttagcgtgtgtcctaatcttctctctgcgtgtaggtaggcctgtgccgcaaacaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9471 - RNA, 4512 nt, synthetic construct
  misc_feature 1..4512: note = Cas9 variant mRNA product
  source 1..4512: mol_type = other RNA
gggagagtccgctcagccaggttgcagaagcggcttagcgtgtgtcctaatcttctctctgcgtgtaggtaggcctgtgccgcaaacaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9472 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9473 - RNA, 4350 nt, synthetic construct
  misc_feature 1..4350: note = Cas9 variant mRNA product
  source 1..4350: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9474 - RNA, 4383 nt, synthetic construct
  misc_feature 1..4383: note = Cas9 variant mRNA product
  source 1..4383: mol_type = other RNA
gggagagtccgctcagccaggttgcagaagcggcttagcgtgtgtcctaatcttctctctgcgtgtaggtaggcctgtgccgcaaacaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9475 - RNA, 3516 nt, synthetic construct
  misc_feature 1..3516: note = Cas9 variant mRNA product
  source 1..3516: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9476 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9477 - RNA, 3600 nt, synthetic construct
  misc_feature 1..3600: note = Cas9 variant mRNA product
  source 1..3600: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9478 - RNA, 3300 nt, synthetic construct
  misc_feature 1..3300: note = Cas9 variant mRNA product
  source 1..3300: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9479 - RNA, 3711 nt, synthetic construct
  misc_feature 1..3711: note = Cas9 variant mRNA product
  source 1..3711: mol_type = other RNA
gggagagtccgctcagccaggttgcagaagcggcttagcgtgtgtcctaatcttctctctgcgtgtaggtaggcctgtgccgcaaacaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9480 - RNA, 4269 nt, synthetic construct
  misc_feature 1..4269: note = Cpf1 variant mRNA product
  source 1..4269: mol_type = other RNA
gggagagtccgctcagccaggttgcagaagcggcttagcgtgtgtcctaatcttctctctgcgtgtaggtaggcctgtgccgcaaacaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9481 - RNA, 4248 nt, synthetic construct
  misc_feature 1..4248: note = Cpf1 variant mRNA product
  source 1..4248: mol_type = other RNA
gggagagtccgctcagccaggttgcagaagcggcttagcgtgtgtcctaatcttctctctgcgtgtaggtaggcctgtgccgcaaacaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9482 - RNA, 4433 nt, synthetic construct
  misc_feature 1..4433: note = Cas9 variant mRNA product
  source 1..4433: mol_type = other RNA
gggagagtcccgcagtcggcgtccagcggctctgcttgttcgtgtgtgtgtcgttgcaggccttattcaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9483 - RNA, 5216 nt, synthetic construct
  misc_feature 1..5216: note = Cas9 variant mRNA product
  source 1..5216: mol_type = other RNA
gggagagtcccgcagtcggcgtccagcggctctgcttgttcgtgtgtgtgtcgttgcaggccttattcaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9484 - RNA, 3488 nt, synthetic construct
  misc_feature 1..3488: note = Cas9 variant mRNA product
  source 1..3488: mol_type = other RNA
gggagagtcccgcagtcggcgtccagcggctctgcttgttcgtgtgtgtgtcgttgcaggccttattcaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9485 - RNA, 4556 nt, synthetic construct
  misc_feature 1..4556: note = Cas9 variant mRNA product
  source 1..4556: mol_type = other RNA
gggagagtcccgcagtcggcgtccagcggctctgcttgttcgtgtgtgtgtcgttgcaggccttattcaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9486 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9487 - RNA, 4493 nt, synthetic construct
  misc_feature 1..4493: note = Cas9 variant mRNA product
  source 1..4493: mol_type = other RNA
gggagagtcccgcagtcggcgtccagcggctctgcttgttcgtgtgtgtgtcgttgcaggccttattcaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9488 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9489 - RNA, 4331 nt, synthetic construct
  misc_feature 1..4331: note = Cas9 variant mRNA product
  source 1..4331: mol_type = other RNA
gggagagtcccgcagtcggcgtccagcggctctgcttgttcgtgtgtgtgtcgttgcaggccttattcaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9490 - RNA, 4364 nt, synthetic construct
  misc_feature 1..4364: note = Cas9 variant mRNA product
  source 1..4364: mol_type = other RNA
gggagagtcccgcagtcggcgtccagcggctctgcttgttcgtgtgtgtgtcgttgcaggccttattcaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9491 - RNA, 3497 nt, synthetic construct
  misc_feature 1..3497: note = Cas9 variant mRNA product
  source 1..3497: mol_type = other RNA
gggagagtcccgcagtcggcgtccagcggctctgcttgttcgtgtgtgtgtcgttgcaggccttattcaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9492 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9493 - RNA, 3581 nt, synthetic construct
  misc_feature 1..3581: note = Cas9 variant mRNA product
  source 1..3581: mol_type = other RNA
gggagagtcccgcagtcggcgtccagcggctctgcttgttcgtgtgtgtgtcgttgcaggccttattcaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9494 - RNA, 3281 nt, synthetic construct
  misc_feature 1..3281: note = Cas9 variant mRNA product
  source 1..3281: mol_type = other RNA
gggagagtcccgcagtcggcgtccagcggctctgcttgttcgtgtgtgtgtcgttgcaggccttattcaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9495 - RNA, 3692 nt, synthetic construct
  misc_feature 1..3692: note = Cas9 variant mRNA product
  source 1..3692: mol_type = other RNA
gggagagtcccgcagtcggcgtccagcggctctgcttgttcgtgtgtgtgtcgttgcaggccttattcaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9496 - RNA, 4250 nt, synthetic construct
  misc_feature 1..4250: note = Cpf1 variant mRNA product
  source 1..4250: mol_type = other RNA
gggagagtcccgcagtcggcgtccagcggctctgcttgttcgtgtgtgtgtcgttgcaggccttattcaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9497 - RNA, 4229 nt, synthetic construct
  misc_feature 1..4229: note = Cpf1 variant mRNA product
  source 1..4229: mol_type = other RNA
gggagagtcccgcagtcggcgtccagcggctctgcttgttcgtgtgtgtgtcgttgcaggccttattcaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 9498 - RNA, 4735 nt, synthetic construct
  misc_feature 1..4735: note = Cas9 variant mRNA product
  source 1..4735: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9499 - RNA, 5518 nt, synthetic construct
  misc_feature 1..5518: note = Cas9 variant mRNA product
  source 1..5518: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9500 - RNA, 3790 nt, synthetic construct
  misc_feature 1..3790: note = Cas9 variant mRNA product
  source 1..3790: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9501 - RNA, 4858 nt, synthetic construct
  misc_feature 1..4858: note = Cas9 variant mRNA product
  source 1..4858: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9502 - RNA, 3934 nt, synthetic construct
  misc_feature 1..3934: note = Cas9 variant mRNA product
  source 1..3934: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9503 - RNA, 4795 nt, synthetic construct
  misc_feature 1..4795: note = Cas9 variant mRNA product
  source 1..4795: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9504 - RNA, 3877 nt, synthetic construct
  misc_feature 1..3877: note = Cas9 variant mRNA product
  source 1..3877: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9505 - RNA, 4633 nt, synthetic construct
  misc_feature 1..4633: note = Cas9 variant mRNA product
  source 1..4633: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9506 - RNA, 4666 nt, synthetic construct
  misc_feature 1..4666: note = Cas9 variant mRNA product
  source 1..4666: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9507 - RNA, 3799 nt, synthetic construct
  misc_feature 1..3799: note = Cas9 variant mRNA product
  source 1..3799: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9508 - RNA, 3877 nt, synthetic construct
  misc_feature 1..3877: note = Cas9 variant mRNA product
  source 1..3877: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9509 - RNA, 3883 nt, synthetic construct
  misc_feature 1..3883: note = Cas9 variant mRNA product
  source 1..3883: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9510 - RNA, 3583 nt, synthetic construct
  misc_feature 1..3583: note = Cas9 variant mRNA product
  source 1..3583: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9511 - RNA, 3994 nt, synthetic construct
  misc_feature 1..3994: note = Cas9 variant mRNA product
  source 1..3994: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9512 - RNA, 4552 nt, synthetic construct
  misc_feature 1..4552: note = Cpf1 variant mRNA product
  source 1..4552: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9513 - RNA, 4531 nt, synthetic construct
  misc_feature 1..4531: note = Cpf1 variant mRNA product
  source 1..4531: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9514 - RNA, 4732 nt, synthetic construct
  misc_feature 1..4732: note = Cas9 variant mRNA product
  source 1..4732: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9515 - RNA, 5515 nt, synthetic construct
  misc_feature 1..5515: note = Cas9 variant mRNA product
  source 1..5515: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9516 - RNA, 3787 nt, synthetic construct
  misc_feature 1..3787: note = Cas9 variant mRNA product
  source 1..3787: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9517 - RNA, 4855 nt, synthetic construct
  misc_feature 1..4855: note = Cas9 variant mRNA product
  source 1..4855: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9518 - RNA, 3931 nt, synthetic construct
  misc_feature 1..3931: note = Cas9 variant mRNA product
  source 1..3931: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9519 - RNA, 4792 nt, synthetic construct
  misc_feature 1..4792: note = Cas9 variant mRNA product
  source 1..4792: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9520 - RNA, 3874 nt, synthetic construct
  misc_feature 1..3874: note = Cas9 variant mRNA product
  source 1..3874: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9521 - RNA, 4630 nt, synthetic construct
  misc_feature 1..4630: note = Cas9 variant mRNA product
  source 1..4630: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9522 - RNA, 4663 nt, synthetic construct
  misc_feature 1..4663: note = Cas9 variant mRNA product
  source 1..4663: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9523 - RNA, 3796 nt, synthetic construct
  misc_feature 1..3796: note = Cas9 variant mRNA product
  source 1..3796: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9524 - RNA, 3874 nt, synthetic construct
  misc_feature 1..3874: note = Cas9 variant mRNA product
  source 1..3874: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9525 - RNA, 3880 nt, synthetic construct
  misc_feature 1..3880: note = Cas9 variant mRNA product
  source 1..3880: mol_type = other RNA
gggagagcggctcggccattttgtcccagtcagtccggaggctgcggctgcagaagtaccgcctgcggagtaactgcaaagaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9526 - RNA, 3580 nt, synthetic construct
  misc_feature 1..3580: note = Cas9 variant mRNA product
  source 1..3580: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9527 - RNA, 3991 nt, synthetic construct
  misc_feature 1..3991: note = Cas9 variant mRNA product
  source 1..3991: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9528 - RNA, 4549 nt, synthetic construct
  misc_feature 1..4549: note = Cpf1 variant mRNA product
  source 1..4549: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9529 - RNA, 4528 nt, synthetic construct
  misc_feature 1..4528: note = Cpf1 variant mRNA product
  source 1..4528: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9530 - RNA, 4732 nt, synthetic construct
  misc_feature 1..4732: note = Cas9 variant mRNA product
  source 1..4732: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9531 - RNA, 5515 nt, synthetic construct
  misc_feature 1..5515: note = Cas9 variant mRNA product
  source 1..5515: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9532 - RNA, 3787 nt, synthetic construct
  misc_feature 1..3787: note = Cas9 variant mRNA product
  source 1..3787: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9533 - RNA, 4855 nt, synthetic construct
  misc_feature 1..4855: note = Cas9 variant mRNA product
  source 1..4855: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9534 - RNA, 3931 nt, synthetic construct
  misc_feature 1..3931: note = Cas9 variant mRNA product
  source 1..3931: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9535 - RNA, 4792 nt, synthetic construct
  misc_feature 1..4792: note = Cas9 variant mRNA product
  source 1..4792: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9536 - RNA, 3874 nt, synthetic construct
  misc_feature 1..3874: note = Cas9 variant mRNA product
  source 1..3874: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9537 - RNA, 4630 nt, synthetic construct
  misc_feature 1..4630: note = Cas9 variant mRNA product
  source 1..4630: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9538 - RNA, 4663 nt, synthetic construct
  misc_feature 1..4663: note = Cas9 variant mRNA product
  source 1..4663: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9539 - RNA, 3796 nt, synthetic construct
  misc_feature 1..3796: note = Cas9 variant mRNA product
  source 1..3796: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9540 - RNA, 3874 nt, synthetic construct
  misc_feature 1..3874: note = Cas9 variant mRNA product
  source 1..3874: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9541 - RNA, 3880 nt, synthetic construct
  misc_feature 1..3880: note = Cas9 variant mRNA product
  source 1..3880: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9542 - RNA, 3580 nt, synthetic construct
  misc_feature 1..3580: note = Cas9 variant mRNA product
  source 1..3580: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9543 - RNA, 3991 nt, synthetic construct
  misc_feature 1..3991: note = Cas9 variant mRNA product
  source 1..3991: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9544 - RNA, 4549 nt, synthetic construct
  misc_feature 1..4549: note = Cpf1 variant mRNA product
  source 1..4549: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9545 - RNA, 4528 nt, synthetic construct
  misc_feature 1..4528: note = Cpf1 variant mRNA product
  source 1..4528: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9546 - RNA, 4732 nt, synthetic construct
  misc_feature 1..4732: note = Cas9 variant mRNA product
  source 1..4732: mol_type = other RNA
gggagagcggctcggccattttgtcccagtcagtccggaggctgcggctgcagaagtaccgcctgcggagtaactgcaaagaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9547 - RNA, 5515 nt, synthetic construct
  misc_feature 1..5515: note = Cas9 variant mRNA product
  source 1..5515: mol_type = other RNA
gggagagcggctcggccattttgtcccagtcagtccggaggctgcggctgcagaagtaccgcctgcggagtaactgcaaagaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9548 - RNA, 3787 nt, synthetic construct
  misc_feature 1..3787: note = Cas9 variant mRNA product
  source 1..3787: mol_type = other RNA
gggagagcggctcggccattttgtcccagtcagtccggaggctgcggctgcagaagtaccgcctgcggagtaactgcaaagaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9549 - RNA, 4855 nt, synthetic construct
  misc_feature 1..4855: note = Cas9 variant mRNA product
  source 1..4855: mol_type = other RNA
gggagagcggctcggccattttgtcccagtcagtccggaggctgcggctgcagaagtaccgcctgcggagtaactgcaaagaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9550 - RNA, 3931 nt, synthetic construct
  misc_feature 1..3931: note = Cas9 variant mRNA product
  source 1..3931: mol_type = other RNA
gggagagcggctcggccattttgtcccagtcagtccggaggctgcggctgcagaagtaccgcctgcggagtaactgcaaagaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9551 - RNA, 4792 nt, synthetic construct
  misc_feature 1..4792: note = Cas9 variant mRNA product
  source 1..4792: mol_type = other RNA
gggagagcggctcggccattttgtcccagtcagtccggaggctgcggctgcagaagtaccgcctgcggagtaactgcaaagaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9552 - RNA, 3874 nt, synthetic construct
  misc_feature 1..3874: note = Cas9 variant mRNA product
  source 1..3874: mol_type = other RNA
gggagagcggctcggccattttgtcccagtcagtccggaggctgcggctgcagaagtaccgcctgcggagtaactgcaaagaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9553 - RNA, 4630 nt, synthetic construct
  misc_feature 1..4630: note = Cas9 variant mRNA product
  source 1..4630: mol_type = other RNA
gggagagcggctcggccattttgtcccagtcagtccggaggctgcggctgcagaagtaccgcctgcggagtaactgcaaagaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9554 - RNA, 4663 nt, synthetic construct
  misc_feature 1..4663: note = Cas9 variant mRNA product
  source 1..4663: mol_type = other RNA
gggagagcggctcggccattttgtcccagtcagtccggaggctgcggctgcagaagtaccgcctgcggagtaactgcaaagaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9555 - RNA, 3796 nt, synthetic construct
  misc_feature 1..3796: note = Cas9 variant mRNA product
  source 1..3796: mol_type = other RNA
gggagagcggctcggccattttgtcccagtcagtccggaggctgcggctgcagaagtaccgcctgcggagtaactgcaaagaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9556 - RNA, 3874 nt, synthetic construct
  misc_feature 1..3874: note = Cas9 variant mRNA product
  source 1..3874: mol_type = other RNA
gggagagcggctcggccattttgtcccagtcagtccggaggctgcggctgcagaagtaccgcctgcggagtaactgcaaagaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9557 - RNA, 3880 nt, synthetic construct
  misc_feature 1..3880: note = Cas9 variant mRNA product
  source 1..3880: mol_type = other RNA
gggagagcggctcggccattttgtcccagtcagtccggaggctgcggctgcagaagtaccgcctgcggagtaactgcaaagaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9558 - RNA, 3580 nt, synthetic construct
  misc_feature 1..3580: note = Cas9 variant mRNA product
  source 1..3580: mol_type = other RNA
gggagagcggctcggccattttgtcccagtcagtccggaggctgcggctgcagaagtaccgcctgcggagtaactgcaaagaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9559 - RNA, 3991 nt, synthetic construct
  misc_feature 1..3991: note = Cas9 variant mRNA product
  source 1..3991: mol_type = other RNA
gggagagcggctcggccattttgtcccagtcagtccggaggctgcggctgcagaagtaccgcctgcggagtaactgcaaagaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9560 - RNA, 4549 nt, synthetic construct
  misc_feature 1..4549: note = Cpf1 variant mRNA product
  source 1..4549: mol_type = other RNA
gggagagcggctcggccattttgtcccagtcagtccggaggctgcggctgcagaagtaccgcctgcggagtaactgcaaagaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9561 - RNA, 4528 nt, synthetic construct
  misc_feature 1..4528: note = Cpf1 variant mRNA product
  source 1..4528: mol_type = other RNA
gggagagcggctcggccattttgtcccagtcagtccggaggctgcggctgcagaagtaccgcctgcggagtaactgcaaagaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9562 - RNA, 4732 nt, synthetic construct
  misc_feature 1..4732: note = Cas9 variant mRNA product
  source 1..4732: mol_type = other RNA
gggagagcggctcggccattttgtcccagtcagtccggaggctgcggctgcagaagtaccgcctgcggagtaactgcaaagaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9563 - RNA, 5515 nt, synthetic construct
  misc_feature 1..5515: note = Cas9 variant mRNA product
  source 1..5515: mol_type = other RNA
gggagagcggctcggccattttgtcccagtcagtccggaggctgcggctgcagaagtaccgcctgcggagtaactgcaaagaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9564 - RNA, 3787 nt, synthetic construct
  misc_feature 1..3787: note = Cas9 variant mRNA product
  source 1..3787: mol_type = other RNA
gggagagcggctcggccattttgtcccagtcagtccggaggctgcggctgcagaagtaccgcctgcggagtaactgcaaagaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9565 - RNA, 4855 nt, synthetic construct
  misc_feature 1..4855: note = Cas9 variant mRNA product
  source 1..4855: mol_type = other RNA
gggagagcggctcggccattttgtcccagtcagtccggaggctgcggctgcagaagtaccgcctgcggagtaactgcaaagaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9566 - RNA, 3931 nt, synthetic construct
  misc_feature 1..3931: note = Cas9 variant mRNA product
  source 1..3931: mol_type = other RNA
gggagagcggctcggccattttgtcccagtcagtccggaggctgcggctgcagaagtaccgcctgcggagtaactgcaaagaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9567 - RNA, 4792 nt, synthetic construct
  misc_feature 1..4792: note = Cas9 variant mRNA product
  source 1..4792: mol_type = other RNA
gggagagcggctcggccattttgtcccagtcagtccggaggctgcggctgcagaagtaccgcctgcggagtaactgcaaagaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9568 - RNA, 3874 nt, synthetic construct
  misc_feature 1..3874: note = Cas9 variant mRNA product
  source 1..3874: mol_type = other RNA
gggagagcggctcggccattttgtcccagtcagtccggaggctgcggctgcagaagtaccgcctgcggagtaactgcaaagaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9569 - RNA, 4630 nt, synthetic construct
  misc_feature 1..4630: note = Cas9 variant mRNA product
  source 1..4630: mol_type = other RNA
gggagagcggctcggccattttgtcccagtcagtccggaggctgcggctgcagaagtaccgcctgcggagtaactgcaaagaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9570 - RNA, 4663 nt, synthetic construct
  misc_feature 1..4663: note = Cas9 variant mRNA product
  source 1..4663: mol_type = other RNA
gggagagcggctcggccattttgtcccagtcagtccggaggctgcggctgcagaagtaccgcctgcggagtaactgcaaagaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9571 - RNA, 3796 nt, synthetic construct
  misc_feature 1..3796: note = Cas9 variant mRNA product
  source 1..3796: mol_type = other RNA
gggagagcggctcggccattttgtcccagtcagtccggaggctgcggctgcagaagtaccgcctgcggagtaactgcaaagaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9572 - RNA, 3874 nt, synthetic construct
  misc_feature 1..3874: note = Cas9 variant mRNA product
  source 1..3874: mol_type = other RNA
gggagagcggctcggccattttgtcccagtcagtccggaggctgcggctgcagaagtaccgcctgcggagtaactgcaaagaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9573 - RNA, 3880 nt, synthetic construct
  misc_feature 1..3880: note = Cas9 variant mRNA product
  source 1..3880: mol_type = other RNA
gggagagcggctcggccattttgtcccagtcagtccggaggctgcggctgcagaagtaccgcctgcggagtaactgcaaagaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9574 - RNA, 3580 nt, synthetic construct
  misc_feature 1..3580: note = Cas9 variant mRNA product
  source 1..3580: mol_type = other RNA
gggagagcggctcggccattttgtcccagtcagtccggaggctgcggctgcagaagtaccgcctgcggagtaactgcaaagaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9575 - RNA, 3991 nt, synthetic construct
  misc_feature 1..3991: note = Cas9 variant mRNA product
  source 1..3991: mol_type = other RNA
gggagagcggctcggccattttgtcccagtcagtccggaggctgcggctgcagaagtaccgcctgcggagtaactgcaaagaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9576 - RNA, 4549 nt, synthetic construct
  misc_feature 1..4549: note = Cpf1 variant mRNA product
  source 1..4549: mol_type = other RNA
gggagagcggctcggccattttgtcccagtcagtccggaggctgcggctgcagaagtaccgcctgcggagtaactgcaaagaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9577 - RNA, 4528 nt, synthetic construct
  misc_feature 1..4528: note = Cpf1 variant mRNA product
  source 1..4528: mol_type = other RNA
gggagagcggctcggccattttgtcccagtcagtccggaggctgcggctgcagaagtaccgcctgcggagtaactgcaaagaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9578 - RNA, 4732 nt, synthetic construct
  misc_feature 1..4732: note = Cas9 variant mRNA product
  source 1..4732: mol_type = other RNA
gggagagcggctcggccattttgtcccagtcagtccggaggctgcggctgcagaagtaccgcctgcggagtaactgcaaagaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9579 - RNA, 5515 nt, synthetic construct
  misc_feature 1..5515: note = Cas9 variant mRNA product
  source 1..5515: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9580 - RNA, 3787 nt, synthetic construct
  misc_feature 1..3787: note = Cas9 variant mRNA product
  source 1..3787: mol_type = other RNA
gggagagcggctcggccattttgtcccagtcagtccggaggctgcggctgcagaagtaccgcctgcggagtaactgcaaagaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9581 - RNA, 4855 nt, synthetic construct
  misc_feature 1..4855: note = Cas9 variant mRNA product
  source 1..4855: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9582 - RNA, 3931 nt, synthetic construct
  misc_feature 1..3931: note = Cas9 variant mRNA product
  source 1..3931: mol_type = other RNA
gggagagcggctcggccattttgtcccagtcagtccggaggctgcggctgcagaagtaccgcctgcggagtaactgcaaagaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9583 - RNA, 4792 nt, synthetic construct
  misc_feature 1..4792: note = Cas9 variant mRNA product
  source 1..4792: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9584 - RNA, 3874 nt, synthetic construct
  misc_feature 1..3874: note = Cas9 variant mRNA product
  source 1..3874: mol_type = other RNA
gggagagcggctcggccattttgtcccagtcagtccggaggctgcggctgcagaagtaccgcctgcggagtaactgcaaagaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9585 - RNA, 4630 nt, synthetic construct
  misc_feature 1..4630: note = Cas9 variant mRNA product
  source 1..4630: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9586 - RNA, 4663 nt, synthetic construct
  misc_feature 1..4663: note = Cas9 variant mRNA product
  source 1..4663: mol_type = other RNA
gggagagcggctcggccattttgtcccagtcagtccggaggctgcggctgcagaagtaccgcctgcggagtaactgcaaagaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9587 - RNA, 3796 nt, synthetic construct
  misc_feature 1..3796: note = Cas9 variant mRNA product
  source 1..3796: mol_type = other RNA
gggagagcggctcggccattttgtcccagtcagtccggaggctgcggctgcagaagtaccgcctgcggagtaactgcaaagaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9588 - RNA, 3874 nt, synthetic construct
  misc_feature 1..3874: note = Cas9 variant mRNA product
  source 1..3874: mol_type = other RNA
gggagagcggctcggccattttgtcccagtcagtccggaggctgcggctgcagaagtaccgcctgcggagtaactgcaaagaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9589 - RNA, 3880 nt, synthetic construct
  misc_feature 1..3880: note = Cas9 variant mRNA product
  source 1..3880: mol_type = other RNA
gggagagcggctcggccattttgtcccagtcagtccggaggctgcggctgcagaagtaccgcctgcggagtaactgcaaagaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9590 - RNA, 3580 nt, synthetic construct
  misc_feature 1..3580: note = Cas9 variant mRNA product
  source 1..3580: mol_type = other RNA
gggagagcggctcggccattttgtcccagtcagtccggaggctgcggctgcagaagtaccgcctgcggagtaactgcaaagaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9591 - RNA, 3991 nt, synthetic construct
  misc_feature 1..3991: note = Cas9 variant mRNA product
  source 1..3991: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9592 - RNA, 4549 nt, synthetic construct
  misc_feature 1..4549: note = Cpf1 variant mRNA product
  source 1..4549: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9593 - RNA, 4528 nt, synthetic construct
  misc_feature 1..4528: note = Cpf1 variant mRNA product
  source 1..4528: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9594 - RNA, 4732 nt, synthetic construct
  misc_feature 1..4732: note = Cas9 variant mRNA product
  source 1..4732: mol_type = other RNA
gggagagcggctcggccattttgtcccagtcagtccggaggctgcggctgcagaagtaccgcctgcggagtaactgcaaagaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9595 - RNA, 5515 nt, synthetic construct
  misc_feature 1..5515: note = Cas9 variant mRNA product
  source 1..5515: mol_type = other RNA
gggagagcggctcggccattttgtcccagtcagtccggaggctgcggctgcagaagtaccgcctgcggagtaactgcaaagaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9596 - RNA, 3787 nt, synthetic construct
  misc_feature 1..3787: note = Cas9 variant mRNA product
  source 1..3787: mol_type = other RNA
gggagagcggctcggccattttgtcccagtcagtccggaggctgcggctgcagaagtaccgcctgcggagtaactgcaaagaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9597 - RNA, 4855 nt, synthetic construct
  misc_feature 1..4855: note = Cas9 variant mRNA product
  source 1..4855: mol_type = other RNA
gggagagcggctcggccattttgtcccagtcagtccggaggctgcggctgcagaagtaccgcctgcggagtaactgcaaagaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9598 - RNA, 3931 nt, synthetic construct
  misc_feature 1..3931: note = Cas9 variant mRNA product
  source 1..3931: mol_type = other RNA
gggagagcggctcggccattttgtcccagtcagtccggaggctgcggctgcagaagtaccgcctgcggagtaactgcaaagaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9599 - RNA, 4792 nt, synthetic construct
  misc_feature 1..4792: note = Cas9 variant mRNA product
  source 1..4792: mol_type = other RNA
gggagagcggctcggccattttgtcccagtcagtccggaggctgcggctgcagaagtaccgcctgcggagtaactgcaaagaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9600 - RNA, 3874 nt, synthetic construct
  misc_feature 1..3874: note = Cas9 variant mRNA product
  source 1..3874: mol_type = other RNA
gggagagcggctcggccattttgtcccagtcagtccggaggctgcggctgcagaagtaccgcctgcggagtaactgcaaagaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9601 - RNA, 4630 nt, synthetic construct
  misc_feature 1..4630: note = Cas9 variant mRNA product
  source 1..4630: mol_type = other RNA
gggagagcggctcggccattttgtcccagtcagtccggaggctgcggctgcagaagtaccgcctgcggagtaactgcaaagaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9602 - RNA, 4663 nt, synthetic construct
  misc_feature 1..4663: note = Cas9 variant mRNA product
  source 1..4663: mol_type = other RNA
gggagagcggctcggccattttgtcccagtcagtccggaggctgcggctgcagaagtaccgcctgcggagtaactgcaaagaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9603 - RNA, 3796 nt, synthetic construct
  misc_feature 1..3796: note = Cas9 variant mRNA product
  source 1..3796: mol_type = other RNA
gggagagcggctcggccattttgtcccagtcagtccggaggctgcggctgcagaagtaccgcctgcggagtaactgcaaagaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9604 - RNA, 3874 nt, synthetic construct
  misc_feature 1..3874: note = Cas9 variant mRNA product
  source 1..3874: mol_type = other RNA
gggagagcggctcggccattttgtcccagtcagtccggaggctgcggctgcagaagtaccgcctgcggagtaactgcaaagaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9605 - RNA, 3880 nt, synthetic construct
  misc_feature 1..3880: note = Cas9 variant mRNA product
  source 1..3880: mol_type = other RNA
gggagagcggctcggccattttgtcccagtcagtccggaggctgcggctgcagaagtaccgcctgcggagtaactgcaaagaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9606 - RNA, 3580 nt, synthetic construct
  misc_feature 1..3580: note = Cas9 variant mRNA product
  source 1..3580: mol_type = other RNA
gggagagcggctcggccattttgtcccagtcagtccggaggctgcggctgcagaagtaccgcctgcggagtaactgcaaagaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9607 - RNA, 3991 nt, synthetic construct
  misc_feature 1..3991: note = Cas9 variant mRNA product
  source 1..3991: mol_type = other RNA
gggagagcggctcggccattttgtcccagtcagtccggaggctgcggctgcagaagtaccgcctgcggagtaactgcaaagaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9608 - RNA, 4549 nt, synthetic construct
  misc_feature 1..4549: note = Cpf1 variant mRNA product
  source 1..4549: mol_type = other RNA
gggagagcggctcggccattttgtcccagtcagtccggaggctgcggctgcagaagtaccgcctgcggagtaactgcaaagaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9609 - RNA, 4528 nt, synthetic construct
  misc_feature 1..4528: note = Cpf1 variant mRNA product
  source 1..4528: mol_type = other RNA
gggagagcggctcggccattttgtcccagtcagtccggaggctgcggctgcagaagtaccgcctgcggagtaactgcaaagaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9610 - RNA, 4525 nt, synthetic construct
  misc_feature 1..4525: note = Cas9 variant mRNA product
  source 1..4525: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9611 - RNA, 5308 nt, synthetic construct
  misc_feature 1..5308: note = Cas9 variant mRNA product
  source 1..5308: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9612 - RNA, 3580 nt, synthetic construct
  misc_feature 1..3580: note = Cas9 variant mRNA product
  source 1..3580: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9613 - RNA, 4648 nt, synthetic construct
  misc_feature 1..4648: note = Cas9 variant mRNA product
  source 1..4648: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9614 - RNA, 3724 nt, synthetic construct
  misc_feature 1..3724: note = Cas9 variant mRNA product
  source 1..3724: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9615 - RNA, 4585 nt, synthetic construct
  misc_feature 1..4585: note = Cas9 variant mRNA product
  source 1..4585: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9616 - RNA, 3667 nt, synthetic construct
  misc_feature 1..3667: note = Cas9 variant mRNA product
  source 1..3667: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9617 - RNA, 4423 nt, synthetic construct
  misc_feature 1..4423: note = Cas9 variant mRNA product
  source 1..4423: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9618 - RNA, 4456 nt, synthetic construct
  misc_feature 1..4456: note = Cas9 variant mRNA product
  source 1..4456: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9619 - RNA, 3589 nt, synthetic construct
  misc_feature 1..3589: note = Cas9 variant mRNA product
  source 1..3589: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9620 - RNA, 3667 nt, synthetic construct
  misc_feature 1..3667: note = Cas9 variant mRNA product
  source 1..3667: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9621 - RNA, 3673 nt, synthetic construct
  misc_feature 1..3673: note = Cas9 variant mRNA product
  source 1..3673: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9622 - RNA, 3373 nt, synthetic construct
  misc_feature 1..3373: note = Cas9 variant mRNA product
  source 1..3373: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9623 - RNA, 3784 nt, synthetic construct
  misc_feature 1..3784: note = Cas9 variant mRNA product
  source 1..3784: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9624 - RNA, 4342 nt, synthetic construct
  misc_feature 1..4342: note = Cpf1 variant mRNA product
  source 1..4342: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9625 - RNA, 4321 nt, synthetic construct
  misc_feature 1..4321: note = Cpf1 variant mRNA product
  source 1..4321: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9626 - RNA, 4522 nt, synthetic construct
  misc_feature 1..4522: note = Cas9 variant mRNA product
  source 1..4522: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9627 - RNA, 5305 nt, synthetic construct
  misc_feature 1..5305: note = Cas9 variant mRNA product
  source 1..5305: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9628 - RNA, 3577 nt, synthetic construct
  misc_feature 1..3577: note = Cas9 variant mRNA product
  source 1..3577: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9629 - RNA, 4645 nt, synthetic construct
  misc_feature 1..4645: note = Cas9 variant mRNA product
  source 1..4645: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9630 - RNA, 3721 nt, synthetic construct
  misc_feature 1..3721: note = Cas9 variant mRNA product
  source 1..3721: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9631 - RNA, 4582 nt, synthetic construct
  misc_feature 1..4582: note = Cas9 variant mRNA product
  source 1..4582: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9632 - RNA, 3664 nt, synthetic construct
  misc_feature 1..3664: note = Cas9 variant mRNA product
  source 1..3664: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9633 - RNA, 4420 nt, synthetic construct
  misc_feature 1..4420: note = Cas9 variant mRNA product
  source 1..4420: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9634 - RNA, 4453 nt, synthetic construct
  misc_feature 1..4453: note = Cas9 variant mRNA product
  source 1..4453: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9635 - RNA, 3586 nt, synthetic construct
  misc_feature 1..3586: note = Cas9 variant mRNA product
  source 1..3586: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9636 - RNA, 3664 nt, synthetic construct
  misc_feature 1..3664: note = Cas9 variant mRNA product
  source 1..3664: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9637 - RNA, 3670 nt, synthetic construct
  misc_feature 1..3670: note = Cas9 variant mRNA product
  source 1..3670: mol_type = other RNA
gggagagtccgctcagccaggttgcagaagcggcttagcgtgtgtcctaatcttctctctgcgtgtaggtaggcctgtgccgcaaacaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9638 - RNA, 3370 nt, synthetic construct
  misc_feature 1..3370: note = Cas9 variant mRNA product
  source 1..3370: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9639 - RNA, 3781 nt, synthetic construct
  misc_feature 1..3781: note = Cas9 variant mRNA product
  source 1..3781: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9640 - RNA, 4339 nt, synthetic construct
  misc_feature 1..4339: note = Cpf1 variant mRNA product
  source 1..4339: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9641 - RNA, 4318 nt, synthetic construct
  misc_feature 1..4318: note = Cpf1 variant mRNA product
  source 1..4318: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9642 - RNA, 4522 nt, synthetic construct
  misc_feature 1..4522: note = Cas9 variant mRNA product
  source 1..4522: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9643 - RNA, 5305 nt, synthetic construct
  misc_feature 1..5305: note = Cas9 variant mRNA product
  source 1..5305: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9644 - RNA, 3577 nt, synthetic construct
  misc_feature 1..3577: note = Cas9 variant mRNA product
  source 1..3577: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9645 - RNA, 4645 nt, synthetic construct
  misc_feature 1..4645: note = Cas9 variant mRNA product
  source 1..4645: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9646 - RNA, 3721 nt, synthetic construct
  misc_feature 1..3721: note = Cas9 variant mRNA product
  source 1..3721: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9647 - RNA, 4582 nt, synthetic construct
  misc_feature 1..4582: note = Cas9 variant mRNA product
  source 1..4582: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9648 - RNA, 3664 nt, synthetic construct
  misc_feature 1..3664: note = Cas9 variant mRNA product
  source 1..3664: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9649 - RNA, 4420 nt, synthetic construct
  misc_feature 1..4420: note = Cas9 variant mRNA product
  source 1..4420: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9650 - RNA, 4453 nt, synthetic construct
  misc_feature 1..4453: note = Cas9 variant mRNA product
  source 1..4453: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9651 - RNA, 3586 nt, synthetic construct
  misc_feature 1..3586: note = Cas9 variant mRNA product
  source 1..3586: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9652 - RNA, 3664 nt, synthetic construct
  misc_feature 1..3664: note = Cas9 variant mRNA product
  source 1..3664: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9653 - RNA, 3670 nt, synthetic construct
  misc_feature 1..3670: note = Cas9 variant mRNA product
  source 1..3670: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9654 - RNA, 3370 nt, synthetic construct
  misc_feature 1..3370: note = Cas9 variant mRNA product
  source 1..3370: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9655 - RNA, 3781 nt, synthetic construct
  misc_feature 1..3781: note = Cas9 variant mRNA product
  source 1..3781: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9656 - RNA, 4339 nt, synthetic construct
  misc_feature 1..4339: note = Cpf1 variant mRNA product
  source 1..4339: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9657 - RNA, 4318 nt, synthetic construct
  misc_feature 1..4318: note = Cpf1 variant mRNA product
  source 1..4318: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9658 - RNA, 4522 nt, synthetic construct
  misc_feature 1..4522: note = Cas9 variant mRNA product
  source 1..4522: mol_type = other RNA
gggagagtccgctcagccaggttgcagaagcggcttagcgtgtgtcctaatcttctctctgcgtgtaggtaggcctgtgccgcaaacaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9659 - RNA, 5305 nt, synthetic construct
  misc_feature 1..5305: note = Cas9 variant mRNA product
  source 1..5305: mol_type = other RNA
gggagagtccgctcagccaggttgcagaagcggcttagcgtgtgtcctaatcttctctctgcgtgtaggtaggcctgtgccgcaaacaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9660 - RNA, 3577 nt, synthetic construct
  misc_feature 1..3577: note = Cas9 variant mRNA product
  source 1..3577: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9661 - RNA, 4645 nt, synthetic construct
  misc_feature 1..4645: note = Cas9 variant mRNA product
  source 1..4645: mol_type = other RNA
gggagagtccgctcagccaggttgcagaagcggcttagcgtgtgtcctaatcttctctctgcgtgtaggtaggcctgtgccgcaaacaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9662 - RNA, 3721 nt, synthetic construct
  misc_feature 1..3721: note = Cas9 variant mRNA product
  source 1..3721: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9663 - RNA, 4582 nt, synthetic construct
  misc_feature 1..4582: note = Cas9 variant mRNA product
  source 1..4582: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9664 - RNA, 3664 nt, synthetic construct
  misc_feature 1..3664: note = Cas9 variant mRNA product
  source 1..3664: mol_type = other RNA
gggagagtccgctcagccaggttgcagaagcggcttagcgtgtgtcctaatcttctctctgcgtgtaggtaggcctgtgccgcaaacaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9665 - RNA, 4420 nt, synthetic construct
  misc_feature 1..4420: note = Cas9 variant mRNA product
  source 1..4420: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9666 - RNA, 4453 nt, synthetic construct
  misc_feature 1..4453: note = Cas9 variant mRNA product
  source 1..4453: mol_type = other RNA
gggagagtccgctcagccaggttgcagaagcggcttagcgtgtgtcctaatcttctctctgcgtgtaggtaggcctgtgccgcaaacaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9667 - RNA, 3586 nt, synthetic construct
  misc_feature 1..3586: note = Cas9 variant mRNA product
  source 1..3586: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9668 - RNA, 3664 nt, synthetic construct
  misc_feature 1..3664: note = Cas9 variant mRNA product
  source 1..3664: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9669 - RNA, 3670 nt, synthetic construct
  misc_feature 1..3670: note = Cas9 variant mRNA product
  source 1..3670: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9670 - RNA, 3370 nt, synthetic construct
  misc_feature 1..3370: note = Cas9 variant mRNA product
  source 1..3370: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9671 - RNA, 3781 nt, synthetic construct
  misc_feature 1..3781: note = Cas9 variant mRNA product
  source 1..3781: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9672 - RNA, 4339 nt, synthetic construct
  misc_feature 1..4339: note = Cpf1 variant mRNA product
  source 1..4339: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9673 - RNA, 4318 nt, synthetic construct
  misc_feature 1..4318: note = Cpf1 variant mRNA product
  source 1..4318: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9674 - RNA, 4522 nt, synthetic construct
  misc_feature 1..4522: note = Cas9 variant mRNA product
  source 1..4522: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9675 - RNA, 5305 nt, synthetic construct
  misc_feature 1..5305: note = Cas9 variant mRNA product
  source 1..5305: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9676 - RNA, 3577 nt, synthetic construct
  misc_feature 1..3577: note = Cas9 variant mRNA product
  source 1..3577: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9677 - RNA, 4645 nt, synthetic construct
  misc_feature 1..4645: note = Cas9 variant mRNA product
  source 1..4645: mol_type = other RNA
gggagagtccgctcagccaggttgcagaagcggcttagcgtgtgtcctaatcttctctctgcgtgtaggtaggcctgtgccgcaaacaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9678 - RNA, 3721 nt, synthetic construct
  misc_feature 1..3721: note = Cas9 variant mRNA product
  source 1..3721: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9679 - RNA, 4582 nt, synthetic construct
  misc_feature 1..4582: note = Cas9 variant mRNA product
  source 1..4582: mol_type = other RNA
gggagagtccgctcagccaggttgcagaagcggcttagcgtgtgtcctaatcttctctctgcgtgtaggtaggcctgtgccgcaaacaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9680 - RNA, 3664 nt, synthetic construct
  misc_feature 1..3664: note = Cas9 variant mRNA product
  source 1..3664: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9681 - RNA, 4420 nt, synthetic construct
  misc_feature 1..4420: note = Cas9 variant mRNA product
  source 1..4420: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9682 - RNA, 4453 nt, synthetic construct
  misc_feature 1..4453: note = Cas9 variant mRNA product
  source 1..4453: mol_type = other RNA
gggagagtccgctcagccaggttgcagaagcggcttagcgtgtgtcctaatcttctctctgcgtgtaggtaggcctgtgccgcaaacaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9683 - RNA, 3586 nt, synthetic construct
  misc_feature 1..3586: note = Cas9 variant mRNA product
  source 1..3586: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9684 - RNA, 3664 nt, synthetic construct
  misc_feature 1..3664: note = Cas9 variant mRNA product
  source 1..3664: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9685 - RNA, 3670 nt, synthetic construct
  misc_feature 1..3670: note = Cas9 variant mRNA product
  source 1..3670: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9686 - RNA, 3370 nt, synthetic construct
  misc_feature 1..3370: note = Cas9 variant mRNA product
  source 1..3370: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9687 - RNA, 3781 nt, synthetic construct
  misc_feature 1..3781: note = Cas9 variant mRNA product
  source 1..3781: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9688 - RNA, 4339 nt, synthetic construct
  misc_feature 1..4339: note = Cpf1 variant mRNA product
  source 1..4339: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9689 - RNA, 4318 nt, synthetic construct
  misc_feature 1..4318: note = Cpf1 variant mRNA product
  source 1..4318: mol_type = other RNA
gggagagtccgctcagccaggttgcagaagcggcttagcgtgtgtcctaatcttctctctgcgtgtaggtaggcctgtgccgcaaacaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9690 - RNA, 4522 nt, synthetic construct
  misc_feature 1..4522: note = Cas9 variant mRNA product
  source 1..4522: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9691 - RNA, 5305 nt, synthetic construct
  misc_feature 1..5305: note = Cas9 variant mRNA product
  source 1..5305: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9692 - RNA, 3577 nt, synthetic construct
  misc_feature 1..3577: note = Cas9 variant mRNA product
  source 1..3577: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9693 - RNA, 4645 nt, synthetic construct
  misc_feature 1..4645: note = Cas9 variant mRNA product
  source 1..4645: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9694 - RNA, 3721 nt, synthetic construct
  misc_feature 1..3721: note = Cas9 variant mRNA product
  source 1..3721: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9695 - RNA, 4582 nt, synthetic construct
  misc_feature 1..4582: note = Cas9 variant mRNA product
  source 1..4582: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9696 - RNA, 3664 nt, synthetic construct
  misc_feature 1..3664: note = Cas9 variant mRNA product
  source 1..3664: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9697 - RNA, 4420 nt, synthetic construct
  misc_feature 1..4420: note = Cas9 variant mRNA product
  source 1..4420: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9698 - RNA, 4453 nt, synthetic construct
  misc_feature 1..4453: note = Cas9 variant mRNA product
  source 1..4453: mol_type = other RNA
gggagagtccgctcagccaggttgcagaagcggcttagcgtgtgtcctaatcttctctctgcgtgtaggtaggcctgtgccgcaaacaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9699 - RNA, 3586 nt, synthetic construct
  misc_feature 1..3586: note = Cas9 variant mRNA product
  source 1..3586: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9700 - RNA, 3664 nt, synthetic construct
  misc_feature 1..3664: note = Cas9 variant mRNA product
  source 1..3664: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9701 - RNA, 3670 nt, synthetic construct
  misc_feature 1..3670: note = Cas9 variant mRNA product
  source 1..3670: mol_type = other RNA
gggagagtccgctcagccaggttgcagaagcggcttagcgtgtgtcctaatcttctctctgcgtgtaggtaggcctgtgccgcaaacaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9702 - RNA, 3370 nt, synthetic construct
  misc_feature 1..3370: note = Cas9 variant mRNA product
  source 1..3370: mol_type = other RNA
gggagagtccgctcagccaggttgcagaagcggcttagcgtgtgtcctaatcttctctctgcgtgtaggtaggcctgtgccgcaaacaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9703 - RNA, 3781 nt, synthetic construct
  misc_feature 1..3781: note = Cas9 variant mRNA product
  source 1..3781: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9704 - RNA, 4339 nt, synthetic construct
  misc_feature 1..4339: note = Cpf1 variant mRNA product
  source 1..4339: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9705 - RNA, 4318 nt, synthetic construct
  misc_feature 1..4318: note = Cpf1 variant mRNA product
  source 1..4318: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9706 - RNA, 4522 nt, synthetic construct
  misc_feature 1..4522: note = Cas9 variant mRNA product
  source 1..4522: mol_type = other RNA
gggagagtccgctcagccaggttgcagaagcggcttagcgtgtgtcctaatcttctctctgcgtgtaggtaggcctgtgccgcaaacaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9707 - RNA, 5305 nt, synthetic construct
  misc_feature 1..5305: note = Cas9 variant mRNA product
  source 1..5305: mol_type = other RNA
gggagagtccgctcagccaggttgcagaagcggcttagcgtgtgtcctaatcttctctctgcgtgtaggtaggcctgtgccgcaaacaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9708 - RNA, 3577 nt, synthetic construct
  misc_feature 1..3577: note = Cas9 variant mRNA product
  source 1..3577: mol_type = other RNA
gggagagtccgctcagccaggttgcagaagcggcttagcgtgtgtcctaatcttctctctgcgtgtaggtaggcctgtgccgcaaacaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9709 - RNA, 4645 nt, synthetic construct
  misc_feature 1..4645: note = Cas9 variant mRNA product
  source 1..4645: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9710 - RNA, 3721 nt, synthetic construct
  misc_feature 1..3721: note = Cas9 variant mRNA product
  source 1..3721: mol_type = other RNA
gggagagtccgctcagccaggttgcagaagcggcttagcgtgtgtcctaatcttctctctgcgtgtaggtaggcctgtgccgcaaacaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9711 - RNA, 4582 nt, synthetic construct
  misc_feature 1..4582: note = Cas9 variant mRNA product
  source 1..4582: mol_type = other RNA
gggagagtccgctcagccaggttgcagaagcggcttagcgtgtgtcctaatcttctctctgcgtgtaggtaggcctgtgccgcaaacaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9712 - RNA, 3664 nt, synthetic construct
  misc_feature 1..3664: note = Cas9 variant mRNA product
  source 1..3664: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9713 - RNA, 4420 nt, synthetic construct
  misc_feature 1..4420: note = Cas9 variant mRNA product
  source 1..4420: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9714 - RNA, 4453 nt, synthetic construct
  misc_feature 1..4453: note = Cas9 variant mRNA product
  source 1..4453: mol_type = other RNA
gggagagtccgctcagccaggttgcagaagcggcttagcgtgtgtcctaatcttctctctgcgtgtaggtaggcctgtgccgcaaacaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9715 - RNA, 3586 nt, synthetic construct
  misc_feature 1..3586: note = Cas9 variant mRNA product
  source 1..3586: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9716 - RNA, 3664 nt, synthetic construct
  misc_feature 1..3664: note = Cas9 variant mRNA product
  source 1..3664: mol_type = other RNA
gggagagtccgctcagccaggttgcagaagcggcttagcgtgtgtcctaatcttctctctgcgtgtaggtaggcctgtgccgcaaacaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9717 - RNA, 3670 nt, synthetic construct
  misc_feature 1..3670: note = Cas9 variant mRNA product
  source 1..3670: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9718 - RNA, 3370 nt, synthetic construct
  misc_feature 1..3370: note = Cas9 variant mRNA product
  source 1..3370: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9719 - RNA, 3781 nt, synthetic construct
  misc_feature 1..3781: note = Cas9 variant mRNA product
  source 1..3781: mol_type = other RNA
gggagagtccgctcagccaggttgcagaagcggcttagcgtgtgtcctaatcttctctctgcgtgtaggtaggcctgtgccgcaaacaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9720 - RNA, 4339 nt, synthetic construct
  misc_feature 1..4339: note = Cpf1 variant mRNA product
  source 1..4339: mol_type = other RNA
gggagagtccgctcagccaggttgcagaagcggcttagcgtgtgtcctaatcttctctctgcgtgtaggtaggcctgtgccgcaaacaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9721 - RNA, 4318 nt, synthetic construct
  misc_feature 1..4318: note = Cpf1 variant mRNA product
  source 1..4318: mol_type = other RNA
gggagagtccgctcagccaggttgcagaagcggcttagcgtgtgtcctaatcttctctctgcgtgtaggtaggcctgtgccgcaaacaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 9722 - RNA, 4741 nt, synthetic construct
  misc_feature 1..4741: note = Cas9 variant mRNA product
  source 1..4741: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9723 - RNA, 5524 nt, synthetic construct
  misc_feature 1..5524: note = Cas9 variant mRNA product
  source 1..5524: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9724 - RNA, 3796 nt, synthetic construct
  misc_feature 1..3796: note = Cas9 variant mRNA product
  source 1..3796: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9725 - RNA, 4864 nt, synthetic construct
  misc_feature 1..4864: note = Cas9 variant mRNA product
  source 1..4864: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9726 - RNA, 3940 nt, synthetic construct
  misc_feature 1..3940: note = Cas9 variant mRNA product
  source 1..3940: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9727 - RNA, 4801 nt, synthetic construct
  misc_feature 1..4801: note = Cas9 variant mRNA product
  source 1..4801: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9728 - RNA, 3883 nt, synthetic construct
  misc_feature 1..3883: note = Cas9 variant mRNA product
  source 1..3883: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9729 - RNA, 4639 nt, synthetic construct
  misc_feature 1..4639: note = Cas9 variant mRNA product
  source 1..4639: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9730 - RNA, 4672 nt, synthetic construct
  misc_feature 1..4672: note = Cas9 variant mRNA product
  source 1..4672: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9731 - RNA, 3805 nt, synthetic construct
  misc_feature 1..3805: note = Cas9 variant mRNA product
  source 1..3805: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9732 - RNA, 3883 nt, synthetic construct
  misc_feature 1..3883: note = Cas9 variant mRNA product
  source 1..3883: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9733 - RNA, 3889 nt, synthetic construct
  misc_feature 1..3889: note = Cas9 variant mRNA product
  source 1..3889: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9734 - RNA, 3589 nt, synthetic construct
  misc_feature 1..3589: note = Cas9 variant mRNA product
  source 1..3589: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9735 - RNA, 4000 nt, synthetic construct
  misc_feature 1..4000: note = Cas9 variant mRNA product
  source 1..4000: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9736 - RNA, 4558 nt, synthetic construct
  misc_feature 1..4558: note = Cpf1 variant mRNA product
  source 1..4558: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9737 - RNA, 4537 nt, synthetic construct
  misc_feature 1..4537: note = Cpf1 variant mRNA product
  source 1..4537: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9738 - RNA, 4738 nt, synthetic construct
  misc_feature 1..4738: note = Cas9 variant mRNA product
  source 1..4738: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9739 - RNA, 5521 nt, synthetic construct
  misc_feature 1..5521: note = Cas9 variant mRNA product
  source 1..5521: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9740 - RNA, 3793 nt, synthetic construct
  misc_feature 1..3793: note = Cas9 variant mRNA product
  source 1..3793: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9741 - RNA, 4861 nt, synthetic construct
  misc_feature 1..4861: note = Cas9 variant mRNA product
  source 1..4861: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9742 - RNA, 3937 nt, synthetic construct
  misc_feature 1..3937: note = Cas9 variant mRNA product
  source 1..3937: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9743 - RNA, 4798 nt, synthetic construct
  misc_feature 1..4798: note = Cas9 variant mRNA product
  source 1..4798: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9744 - RNA, 3880 nt, synthetic construct
  misc_feature 1..3880: note = Cas9 variant mRNA product
  source 1..3880: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9745 - RNA, 4636 nt, synthetic construct
  misc_feature 1..4636: note = Cas9 variant mRNA product
  source 1..4636: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9746 - RNA, 4669 nt, synthetic construct
  misc_feature 1..4669: note = Cas9 variant mRNA product
  source 1..4669: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9747 - RNA, 3802 nt, synthetic construct
  misc_feature 1..3802: note = Cas9 variant mRNA product
  source 1..3802: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9748 - RNA, 3880 nt, synthetic construct
  misc_feature 1..3880: note = Cas9 variant mRNA product
  source 1..3880: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9749 - RNA, 3886 nt, synthetic construct
  misc_feature 1..3886: note = Cas9 variant mRNA product
  source 1..3886: mol_type = other RNA
gggagagtccgctcagccaggttgcagaagcggcttagcgtgtgtcctaatcttctctctgcgtgtaggtaggcctgtgccgcaaacaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9750 - RNA, 3586 nt, synthetic construct
  misc_feature 1..3586: note = Cas9 variant mRNA product
  source 1..3586: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9751 - RNA, 3997 nt, synthetic construct
  misc_feature 1..3997: note = Cas9 variant mRNA product
  source 1..3997: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9752 - RNA, 4555 nt, synthetic construct
  misc_feature 1..4555: note = Cpf1 variant mRNA product
  source 1..4555: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9753 - RNA, 4534 nt, synthetic construct
  misc_feature 1..4534: note = Cpf1 variant mRNA product
  source 1..4534: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9754 - RNA, 4738 nt, synthetic construct
  misc_feature 1..4738: note = Cas9 variant mRNA product
  source 1..4738: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9755 - RNA, 5521 nt, synthetic construct
  misc_feature 1..5521: note = Cas9 variant mRNA product
  source 1..5521: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9756 - RNA, 3793 nt, synthetic construct
  misc_feature 1..3793: note = Cas9 variant mRNA product
  source 1..3793: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9757 - RNA, 4861 nt, synthetic construct
  misc_feature 1..4861: note = Cas9 variant mRNA product
  source 1..4861: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9758 - RNA, 3937 nt, synthetic construct
  misc_feature 1..3937: note = Cas9 variant mRNA product
  source 1..3937: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9759 - RNA, 4798 nt, synthetic construct
  misc_feature 1..4798: note = Cas9 variant mRNA product
  source 1..4798: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9760 - RNA, 3880 nt, synthetic construct
  misc_feature 1..3880: note = Cas9 variant mRNA product
  source 1..3880: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9761 - RNA, 4636 nt, synthetic construct
  misc_feature 1..4636: note = Cas9 variant mRNA product
  source 1..4636: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9762 - RNA, 4669 nt, synthetic construct
  misc_feature 1..4669: note = Cas9 variant mRNA product
  source 1..4669: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9763 - RNA, 3802 nt, synthetic construct
  misc_feature 1..3802: note = Cas9 variant mRNA product
  source 1..3802: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9764 - RNA, 3880 nt, synthetic construct
  misc_feature 1..3880: note = Cas9 variant mRNA product
  source 1..3880: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9765 - RNA, 3886 nt, synthetic construct
  misc_feature 1..3886: note = Cas9 variant mRNA product
  source 1..3886: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9766 - RNA, 3586 nt, synthetic construct
  misc_feature 1..3586: note = Cas9 variant mRNA product
  source 1..3586: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9767 - RNA, 3997 nt, synthetic construct
  misc_feature 1..3997: note = Cas9 variant mRNA product
  source 1..3997: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9768 - RNA, 4555 nt, synthetic construct
  misc_feature 1..4555: note = Cpf1 variant mRNA product
  source 1..4555: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9769 - RNA, 4534 nt, synthetic construct
  misc_feature 1..4534: note = Cpf1 variant mRNA product
  source 1..4534: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9770 - RNA, 4738 nt, synthetic construct
  misc_feature 1..4738: note = Cas9 variant mRNA product
  source 1..4738: mol_type = other RNA
gggagagtccgctcagccaggttgcagaagcggcttagcgtgtgtcctaatcttctctctgcgtgtaggtaggcctgtgccgcaaacaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9771 - RNA, 5521 nt, synthetic construct
  misc_feature 1..5521: note = Cas9 variant mRNA product
  source 1..5521: mol_type = other RNA
gggagagtccgctcagccaggttgcagaagcggcttagcgtgtgtcctaatcttctctctgcgtgtaggtaggcctgtgccgcaaacaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9772 - RNA, 3793 nt, synthetic construct
  misc_feature 1..3793: note = Cas9 variant mRNA product
  source 1..3793: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9773 - RNA, 4861 nt, synthetic construct
  misc_feature 1..4861: note = Cas9 variant mRNA product
  source 1..4861: mol_type = other RNA
gggagagtccgctcagccaggttgcagaagcggcttagcgtgtgtcctaatcttctctctgcgtgtaggtaggcctgtgccgcaaacaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9774 - RNA, 3937 nt, synthetic construct
  misc_feature 1..3937: note = Cas9 variant mRNA product
  source 1..3937: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9775 - RNA, 4798 nt, synthetic construct
  misc_feature 1..4798: note = Cas9 variant mRNA product
  source 1..4798: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9776 - RNA, 3880 nt, synthetic construct
  misc_feature 1..3880: note = Cas9 variant mRNA product
  source 1..3880: mol_type = other RNA
gggagagtccgctcagccaggttgcagaagcggcttagcgtgtgtcctaatcttctctctgcgtgtaggtaggcctgtgccgcaaacaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9777 - RNA, 4636 nt, synthetic construct
  misc_feature 1..4636: note = Cas9 variant mRNA product
  source 1..4636: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9778 - RNA, 4669 nt, synthetic construct
  misc_feature 1..4669: note = Cas9 variant mRNA product
  source 1..4669: mol_type = other RNA
gggagagtccgctcagccaggttgcagaagcggcttagcgtgtgtcctaatcttctctctgcgtgtaggtaggcctgtgccgcaaacaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9779 - RNA, 3802 nt, synthetic construct
  misc_feature 1..3802: note = Cas9 variant mRNA product
  source 1..3802: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9780 - RNA, 3880 nt, synthetic construct
  misc_feature 1..3880: note = Cas9 variant mRNA product
  source 1..3880: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9781 - RNA, 3886 nt, synthetic construct
  misc_feature 1..3886: note = Cas9 variant mRNA product
  source 1..3886: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9782 - RNA, 3586 nt, synthetic construct
  misc_feature 1..3586: note = Cas9 variant mRNA product
  source 1..3586: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9783 - RNA, 3997 nt, synthetic construct
  misc_feature 1..3997: note = Cas9 variant mRNA product
  source 1..3997: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9784 - RNA, 4555 nt, synthetic construct
  misc_feature 1..4555: note = Cpf1 variant mRNA product
  source 1..4555: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9785 - RNA, 4534 nt, synthetic construct
  misc_feature 1..4534: note = Cpf1 variant mRNA product
  source 1..4534: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9786 - RNA, 4738 nt, synthetic construct
  misc_feature 1..4738: note = Cas9 variant mRNA product
  source 1..4738: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9787 - RNA, 5521 nt, synthetic construct
  misc_feature 1..5521: note = Cas9 variant mRNA product
  source 1..5521: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9788 - RNA, 3793 nt, synthetic construct
  misc_feature 1..3793: note = Cas9 variant mRNA product
  source 1..3793: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9789 - RNA, 4861 nt, synthetic construct
  misc_feature 1..4861: note = Cas9 variant mRNA product
  source 1..4861: mol_type = other RNA
gggagagtccgctcagccaggttgcagaagcggcttagcgtgtgtcctaatcttctctctgcgtgtaggtaggcctgtgccgcaaacaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9790 - RNA, 3937 nt, synthetic construct
  misc_feature 1..3937: note = Cas9 variant mRNA product
  source 1..3937: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9791 - RNA, 4798 nt, synthetic construct
  misc_feature 1..4798: note = Cas9 variant mRNA product
  source 1..4798: mol_type = other RNA
gggagagtccgctcagccaggttgcagaagcggcttagcgtgtgtcctaatcttctctctgcgtgtaggtaggcctgtgccgcaaacaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9792 - RNA, 3880 nt, synthetic construct
  misc_feature 1..3880: note = Cas9 variant mRNA product
  source 1..3880: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9793 - RNA, 4636 nt, synthetic construct
  misc_feature 1..4636: note = Cas9 variant mRNA product
  source 1..4636: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9794 - RNA, 4669 nt, synthetic construct
  misc_feature 1..4669: note = Cas9 variant mRNA product
  source 1..4669: mol_type = other RNA
gggagagtccgctcagccaggttgcagaagcggcttagcgtgtgtcctaatcttctctctgcgtgtaggtaggcctgtgccgcaaacaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9795 - RNA, 3802 nt, synthetic construct
  misc_feature 1..3802: note = Cas9 variant mRNA product
  source 1..3802: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9796 - RNA, 3880 nt, synthetic construct
  misc_feature 1..3880: note = Cas9 variant mRNA product
  source 1..3880: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9797 - RNA, 3886 nt, synthetic construct
  misc_feature 1..3886: note = Cas9 variant mRNA product
  source 1..3886: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9798 - RNA, 3586 nt, synthetic construct
  misc_feature 1..3586: note = Cas9 variant mRNA product
  source 1..3586: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9799 - RNA, 3997 nt, synthetic construct
  misc_feature 1..3997: note = Cas9 variant mRNA product
  source 1..3997: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9800 - RNA, 4555 nt, synthetic construct
  misc_feature 1..4555: note = Cpf1 variant mRNA product
  source 1..4555: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9801 - RNA, 4534 nt, synthetic construct
  misc_feature 1..4534: note = Cpf1 variant mRNA product
  source 1..4534: mol_type = other RNA
gggagagtccgctcagccaggttgcagaagcggcttagcgtgtgtcctaatcttctctctgcgtgtaggtaggcctgtgccgcaaacaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9802 - RNA, 4738 nt, synthetic construct
  misc_feature 1..4738: note = Cas9 variant mRNA product
  source 1..4738: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9803 - RNA, 5521 nt, synthetic construct
  misc_feature 1..5521: note = Cas9 variant mRNA product
  source 1..5521: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9804 - RNA, 3793 nt, synthetic construct
  misc_feature 1..3793: note = Cas9 variant mRNA product
  source 1..3793: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9805 - RNA, 4861 nt, synthetic construct
  misc_feature 1..4861: note = Cas9 variant mRNA product
  source 1..4861: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9806 - RNA, 3937 nt, synthetic construct
  misc_feature 1..3937: note = Cas9 variant mRNA product
  source 1..3937: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9807 - RNA, 4798 nt, synthetic construct
  misc_feature 1..4798: note = Cas9 variant mRNA product
  source 1..4798: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9808 - RNA, 3880 nt, synthetic construct
  misc_feature 1..3880: note = Cas9 variant mRNA product
  source 1..3880: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9809 - RNA, 4636 nt, synthetic construct
  misc_feature 1..4636: note = Cas9 variant mRNA product
  source 1..4636: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9810 - RNA, 4669 nt, synthetic construct
  misc_feature 1..4669: note = Cas9 variant mRNA product
  source 1..4669: mol_type = other RNA
gggagagtccgctcagccaggttgcagaagcggcttagcgtgtgtcctaatcttctctctgcgtgtaggtaggcctgtgccgcaaacaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9811 - RNA, 3802 nt, synthetic construct
  misc_feature 1..3802: note = Cas9 variant mRNA product
  source 1..3802: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9812 - RNA, 3880 nt, synthetic construct
  misc_feature 1..3880: note = Cas9 variant mRNA product
  source 1..3880: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9813 - RNA, 3886 nt, synthetic construct
  misc_feature 1..3886: note = Cas9 variant mRNA product
  source 1..3886: mol_type = other RNA
gggagagtccgctcagccaggttgcagaagcggcttagcgtgtgtcctaatcttctctctgcgtgtaggtaggcctgtgccgcaaacaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9814 - RNA, 3586 nt, synthetic construct
  misc_feature 1..3586: note = Cas9 variant mRNA product
  source 1..3586: mol_type = other RNA
gggagagtccgctcagccaggttgcagaagcggcttagcgtgtgtcctaatcttctctctgcgtgtaggtaggcctgtgccgcaaacaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9815 - RNA, 3997 nt, synthetic construct
  misc_feature 1..3997: note = Cas9 variant mRNA product
  source 1..3997: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9816 - RNA, 4555 nt, synthetic construct
  misc_feature 1..4555: note = Cpf1 variant mRNA product
  source 1..4555: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9817 - RNA, 4534 nt, synthetic construct
  misc_feature 1..4534: note = Cpf1 variant mRNA product
  source 1..4534: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9818 - RNA, 4738 nt, synthetic construct
  misc_feature 1..4738: note = Cas9 variant mRNA product
  source 1..4738: mol_type = other RNA
gggagagtccgctcagccaggttgcagaagcggcttagcgtgtgtcctaatcttctctctgcgtgtaggtaggcctgtgccgcaaacaagcttaccatggctccaaaaaaaaaacgaaaagttggaatccacggggtgccagccgctgacaaaaaatatagcattggcctagacatcgggacaaactcggtcggttgggcagttatcaccgatgagtataaagtgccctctaaaaaattcaaagtcctaggaaatacagatcgacattcaattaaaaagaacctaataggagcccttttatttgacagtggtgaaacagctgaagctacaaggctcaaacgaacagctcgaaggcgatacacgagacgtaaaaaccgcatttgttacttacaagagatattcagcaatgaaatggcaaaagtagatgactcctttttccatagactagaagagtcatttctcgtggaagaagataaaaaacacgaaagacatccaatatttggcaatatagtcgatgaagttgcctatcacgaaaaataccccaccatctatcacctaaggaaaaaattagtagactcaacagataaagcagacttaagattaatctatcttgcactagctcacatgattaaattcagaggacactttctaattgaaggagatttaaaccctgacaatagtgatgtagataaattatttatacaactagtacaaacatacaatcaactgtttgaagaaaatccaataaatgccagcggcgtagatgcaaaagcaatcttaagcgctagactctccaaatcgagaaggctagaaaacctcatagcacaactcccaggggagaaaaagaatggattattcggtaacctcatcgcactaagtttaggtcttaccccaaatttcaaaagcaatttcgacttagcagaagacgccaaactacagttatcaaaagatacatatgatgatgacctagataacttactagcccaaatcggagatcaatacgctgatctatttcttgcagccaaaaatctctccgatgccattctattaagtgacatactacgtgtcaatacagaaataacaaaagctccattatcagcaagcatgataaaaagatatgacgaacaccaccaagacctaactctgttaaaagcacttgttcgacaacaactaccagaaaaatataaagaaattttttttgaccaatcgaaaaatggatatgccggctatatagatggaggagcatcccaagaagaattctataaatttataaaaccaatattggaaaaaatggatggcacagaagaactactcgttaaactaaacagagaagatttactacgaaaacaaagaacctttgacaatggaagtataccacaccagatccacctaggcgaactacacgcaatcctacgcagacaagaggatttctacccattcctaaaagataaccgtgaaaaaatagagaaaatattaacatttagaataccctattacgttggaccactagcccgaggaaatagtcgttttgcgtggatgaccagaaagagcgaagaaacaataacaccatggaatttcgaagaagttgtggataaaggagcatccgcacagagctttatcgaacgaatgacaaattttgacaaaaacttaccaaacgaaaaagtcttaccaaagcactcactattatacgaatactttaccgtttacaacgagttaacaaaagtcaaatacgtcacagaaggcatgagaaaacctgcctttctctccggagaacaaaaaaaagcaatagtcgacctcctattcaaaaccaatcgaaaagtaactgttaaacaactaaaagaagactactttaaaaaaatagaatgttttgattccgtagaaatatctggcgttgaagacagatttaacgcatcactaggaacttaccacgatttattaaaaattataaaggacaaagattttttagacaacgaagagaatgaggacatacttgaagatatagtactcactctcacactatttgaggaccgcgaaatgatagaagaacgactaaagacctatgcccatttattcgacgataaggttatgaaacaactgaaacgccgaaggtacacgggctggggacgtcttagtcgaaaattaataaatggaatacgtgacaaacaatcaggaaaaacaatattagatttcctaaaatcagacggcttcgctaatagaaattttatgcaattgatacacgatgacagtttaacttttaaagaagatatacaaaaagctcaggtatcaggtcaaggagattctctacatgaacatatagcaaacttagccggaagtccagcaataaaaaaaggtatcctacaaacggtaaaagtcgtggacgaactcgtaaaagtaatgggacgtcacaaaccagaaaacatagtgattgaaatggccagagaaaaccaaactactcaaaaaggtcaaaagaatagcagagaaaggatgaaacgcattgaggaaggaataaaagagttgggatcacaaatattaaaagaacatcccgtagaaaatactcaattacaaaatgaaaaattgtacttatattatctccaaaacggcagagatatgtatgtagatcaagaattagacataaatagacttagtgattatgacgtagaccatatcgttccccaaagtttcctcaaagatgatagcatagataacaaagttttgacgagatcggataaaaatagggggaaatctgataatgttccaagtgaagaagtggttaaaaaaatgaagaattactggcgtcaactgctaaacgccaagcttattacacaacggaagtttgacaacttaacaaaagcagagcgaggcggtttaagtgagttagataaagcaggttttattaaaagacaattggtagaaaccagacaaattactaaacacgtagcgcaaatcctagacagtagaatgaatacaaagtacgacgaaaacgacaaactaatacgcgaagttaaagtaataaccttaaaaagtaaacttgtatcagatttcagaaaagatttccaattttacaaagttagggaaataaataactaccatcacgcacatgatgcatacctaaacgcggttgtaggcacagcattaataaaaaaatatcccaaattagaaagcgaatttgtctatggagattacaaagtctatgacgtaagaaaaatgatcgcaaagtcagagcaagagataggaaaggccactgcaaaatatttcttttattcaaacataatgaacttttttaagacagagataacgcttgctaacggcgaaatcagaaagcgaccactaatcgaaacaaacggagagacgggggaaatagtttgggacaaaggtagagactttgcaacagtacgaaaagttttgtctatgcctcaagtcaacatagtcaaaaaaacagaagtacaaacaggaggattttccaaggagtcaattttaccaaaaagaaattcagataaattaattgccagaaaaaaagactgggacccaaaaaaatatggcggatttgattctcctaccgtagcttactcagttttagtagtggccaaagtggaaaaaggaaaaagcaaaaaactaaaatcagttaaagaattactaggcattactataatggaaagaagcagtttcgaaaaaaacccaattgactttctcgaagctaaaggatacaaagaagtaaaaaaagacctaatcataaaactacccaaatattctctttttgaattagaaaacggaagaaagagaatgttggcgagtgcaggagaattacaaaagggtaatgaattagccctcccatcaaaatacgtaaactttctatacttagcatctcactatgaaaaattaaaaggatcaccagaagataatgaacaaaaacagctatttgtagaacaacataaacattatctcgatgaaataatcgaacagataagtgaattctcaaaaagagtcatcttagctgatgcaaacttagacaaggtcctgtctgcatataataaacacagagataaaccgattcgcgagcaagctgaaaacataattcatttatttacacttactaatttaggagcgcctgcggcttttaaatacttcgatactacaatcgatagaaaaagatacacaagcactaaagaagtcctcgacgcaacattaattcatcaatctattaccggactatatgaaacaagaatcgatttaagccaacttggaggagacaaaagacctgctgcgacaaaaaaagcagggcaagccaaaaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9819 - RNA, 5521 nt, synthetic construct
  misc_feature 1..5521: note = Cas9 variant mRNA product
  source 1..5521: mol_type = other RNA
gggagagtccgctcagccaggttgcagaagcggcttagcgtgtgtcctaatcttctctctgcgtgtaggtaggcctgtgccgcaaacaagcttaccatggcacccaaaaaaaaacggaaagtgggtatacacggtgtgcccgcagctaattttaaaatcttgcccatagcgattgacctaggcgtcaaaaatacgggcgtattctccgcattctaccaaaaagggacatcattagaacgcctagacaacaaaaacggtaaagtttacgaactttccaaagactcttacaccttactcatgaacaaccgcacagcccgacgacaccaaaggagaggaatagaccgtaaacaactggtcaagagattatttaaactaatatggacagagcagctaaatctagaatgggacaaagatacacaacaagcaatatctttcttatttaaccgaagaggattctcatttatcacagatggatacagtccagaatacttaaacatcgttcctgaacaggtaaaagccatattgatggacatctttgatgattacaatggggaagatgacctcgacagctatctaaaacttgccaccgaacaagaaagcaagatctcagaaatctacaataaattaatgcaaaaaatcttagaatttaaattaatgaaactctgtaccgacattaaggatgataaagtatctacaaaaaccctcaaagaaattacctcttatgaatttgaattattagcagattacctagccaactactccgaatctcttaaaactcaaaagttttcatacaccgataaacaaggaaatctgaaagagctaagttactatcatcatgacaaatataacatccaagaattccttaaaagacatgcaacaataaacgacagaatattggataccttacttaccgacgatctagatatttggaatttcaactttgaaaaattcgacttcgacaaaaacgaagaaaaattacaaaatcaagaagacaaagaccacattcaagcacacctccaccatttcgtattcgcagtgaacaaaatcaaaagtgaaatggcctcaggaggtagacatcggagtcaatacttccaagaaatcacaaacgtcctagacgaaaacaatcaccaggaaggatacttaaaaaacttctgtgaaaatttacacaataaaaaatatagcaatctgtcagtaaaaaatcttgtaaatctgataggaaacctctcgaacttggaactgaagccactacgaaagtacttcaatgataaaattcacgcgaaagcagatcattgggacgaacaaaaattcactgaaacatactgccattggattcttggtgaatggagagtaggtgttaaagaccaagacaaaaaagacggcgccaagtactcatacaaagatctatgcaacgaactaaaacaaaaagtaacaaaagcggggctagtcgattttctcctagaattagatccttgtcgaactattcctccctacctcgacaacaataatagaaaacccccaaaatgtcaatctctaatactaaaccccaaatttctagacaatcaatacccaaactggcaacaatacttacaagaactcaaaaaactacaatcaatccagaactatcttgatagctttgaaactgacctaaaggtattaaaatcttcaaaagatcaaccatattttgtagaatataaaagttctaatcaacaaatcgctagtgggcagagagattacaaagatttggacgccagaatactccaatttatattcgatagagttaaagcatcagacgaactacttttaaacgaaatttattttcaggcgaagaagctaaaacaaaaggcgagcagtgaactggaaaaactcgaaagcagcaaaaaattagatgaggtaatagctaactcacaactttcacaaatccttaaatcacaacacacaaatggaatatttgaacaagggacctttttacatctagtatgtaaatattacaaacaaaggcaaagagcaagggatagccgattatacatcatgccagaatacagatatgataaaaaactgcacaaatataacaacacaggacgctttgacgacgacaaccaactcttaacgtattgcaatcataaacccagacagaaacgctatcaattactaaacgacctagctggagtcctacaagtttcccccaatttcctgaaagataaaatcggttccgacgatgacctatttattagcaaatggcttgtagaacacattagaggattcaaaaaagcatgtgaagattcactaaaaatacaaaaagacaatagaggactattaaatcacaaaattaatatcgcaaggaataccaaaggaaaatgtgaaaaagaaatcttcaatttaatttgcaaaatagaaggctcagaagataaaaaaggaaactacaaacatggactcgcatatgagctcggagtattattattcggtgagcccaatgaagcatctaaaccagagtttgatcgcaaaataaaaaagtttaactcgatctactcgtttgcccaaattcagcaaattgcctttgcagaacgaaagggaaatgccaacacttgcgctgtatgctcagccgacaacgcacaccgtatgcaacaaataaaaataactgaaccagtagaagacaataaagacaaaataattctaagcgcaaaagcacaaagactgccagccatacctacaagaatcgtcgacggagcagtcaaaaaaatggcaactatattagctaaaaatatagtagacgataactggcaaaacataaaacaggtgttaagcgcgaaacatcaattacacattcccatcattactgagtccaacgccttcgaattcgaaccagcccttgcagacgttaaaggcaaaagtttaaaagaccgaagaaaaaaagcattagaaaggataagtcccgaaaacatcttcaaagacaaaaataaccgtattaaagaattcgccaaaggaatatctgcctacagcggtgcaaacctaacagacggtgatttcgacggagccaaagaagagctagatcatattataccccgatcccataaaaaatacggaactttgaatgacgaagcaaacctaatatgcgtaacacgaggagacaacaaaaacaaagggaatagaatattttgtcttagagatttagccgataattataaattaaaacaatttgaaactaccgatgacttagagatagaaaaaaaaatagccgacacaatatgggacgctaataaaaaagacttcaaattcgggaattatcgatccttcattaatctaacgccccaagaacaaaaggcattccgacatgcattattcttagcagacgagaacccaataaaacaggccgtaataagagctataaacaaccgaaatcgaacttttgttaatggaacacaacgctattttgcagaagtactggcaaataatatctatcttagagccaaaaaagaaaacctaaatactgacaaaatttcttttgactattttggaatacccaccattggaaatggcaggggaatagctgaaataagacaattatatgaaaaggtagactccgacatccaagcatatgcaaaaggggataaaccacaagcttcctattcacacctaatagacgcaatgttagctttctgcattgcagctgacgagcataggaatgacggaagcataggacttgaaatagataaaaactactccctataccccctcgataaaaacacaggagaagtttttacaaaagatatattttcacaaataaagataacggacaacgagttctcagataaaaaactagtaagaaagaaagcaatcgaaggatttaacacacaccgccaaatgactcgcgacggcatttatgctgaaaattaccttcccatactaattcacaaagaactaaacgaagtacgtaaaggatacacttggaagaattcagaagaaattaaaatttttaaaggaaaaaagtacgatatacaacaactcaacaatttagtgtattgcctaaaatttgtagataaaccaatatcaatagacatccagatctcaacactagaagaattacgtaacatattgacgaccaataacatcgcagctacagcagaatattactatatcaacttgaaaacccagaagttacatgaatactacatagaaaactataatacagctctaggctacaaaaaatattcaaaagagatggaattccttagatcacttgcatatcgaagcgaacgagtaaagatcaaatcgatcgatgacgtcaaacaagtcttggataaagatagcaacttcataataggaaaaataaccctcccttttaaaaaagaatggcaacggctgtatagagaatggcaaaacacaaccattaaagatgactatgaattcctaaaatccttttttaacgtaaaatccataactaagcttcacaaaaaagtaagaaaagactttagcttaccaatatccacaaacgaaggcaaatttctagtaaagcgcaaaacatgggataataactttatctatcaaatattaaatgatagcgatagtcgcgcggacggcacaaaacccttcatccctgccttcgacatatcgaaaaatgaaatagttgaagcaataatcgactcattcaccagtaaaaacatattttggcttcctaagaacatcgaattacaaaaagtggacaataaaaatatatttgcaattgacacctcaaagtggtttgaagtagagaccccaagcgacctccgtgacataggcatagcaacaatccaatataaaatagacaataactcaagaccaaaagtcagagttaaactagactatgtaattgatgatgacagtaaaataaactacttcatgaatcactcattactaaaaagcagatatccagataaagtacttgaaatattaaaacaaagcactataatagagttcgaatcatctggattcaacaaaacaataaaagaaatgcttggtatgaaattggcaggcatatacaacgaaacaagtaacaataaaagacctgcagcaacaaaaaaggccggacaagcaaaaaaaaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9820 - RNA, 3793 nt, synthetic construct
  misc_feature 1..3793: note = Cas9 variant mRNA product
  source 1..3793: mol_type = other RNA
gggagagtccgctcagccaggttgcagaagcggcttagcgtgtgtcctaatcttctctctgcgtgtaggtaggcctgtgccgcaaacaagcttaccatggcaccaaaaaagaaaagaaaagttggtattcatggagtaccagcagcaaaaaggaactatatattaggcttagacataggaataacctcagtaggatatgggataatagactatgaaaccagagatgtaatcgatgccggtgtacgccttttcaaggaagcaaacgtggaaaacaatgaaggcagaagatcaaaaagaggagcaagaaggttaaaacgacgcagaagacatagaatacaacgagtcaagaaacttctgttcgactataacctactaactgaccactcagagctatcaggcataaacccgtatgaagcacgagtaaagggcttaagccaaaagttatcagaagaagaattctccgctgccttactgcatttagcaaaaagaaggggagttcataacgtaaatgaagtcgaagaagacacgggtaacgaacttagtaccaaagagcaaataagtcgaaactccaaagcactagaagaaaaatatgtagcagaactgcagctagaacgtttaaaaaaagacggagaagtacgaggatctataaatcgatttaaaacgtccgattacgtaaaagaagcaaaacaattgttaaaggtacaaaaagcttaccaccaactagatcaatcatttatcgatacctatatagatttactagaaactcgacgtacctattacgaaggaccaggtgaaggctcaccctttggctggaaagatattaaagaatggtatgaaatgcttatgggacactgcacctatttccctgaggaattaaggtccgtaaaatacgcatacaatgctgacctatacaacgcattaaacgacctaaataacctagtaattaccagagatgaaaacgaaaaactagaatactacgaaaaattccaaatcatcgaaaatgtgtttaaacaaaaaaaaaaaccaactctaaagcaaattgcaaaagaaatactcgtaaatgaggaagatatcaaaggatacagagttacatcaacagggaaacctgaattcacaaacctaaaagtataccacgatataaaggatataacagccagaaaagaaattatagagaacgcggaattactagatcaaattgcaaaaatcctgaccatataccaaagttcagaagacatccaagaagaactaactaacctaaacagcgaattaacccaagaagagatagagcaaatatctaatttaaaaggctacacaggaacacacaacttatcattaaaagcaattaatttgatcctagacgaactatggcacacaaacgataaccagatcgccatttttaataggttaaaactagtaccgaaaaaagtggatttatcacaacaaaaagaaatccccacaactttagtagacgattttatcctatcaccagtagtaaagagatcatttattcaatcaattaaagtaataaacgcaataattaaaaaatacggcttacccaacgacatcataatagaacttgcgcgagaaaaaaactcaaaagacgcacaaaaaatgataaatgaaatgcagaaaagaaatagacaaacaaatgaacgcattgaggaaatcataaggacaaccggaaaagaaaacgcaaaatacttgatagagaagataaaacttcacgacatgcaagaaggaaaatgtttatactctctcgaagccatcccattagaagacctactaaataatccatttaattacgaagtcgatcatataataccccgatctgtaagcttcgacaacagttttaacaacaaagtacttgtaaagcaagaagaaaactcaaaaaaagggaatagaactcccttccagtacttatcaagctcagattcaaaaatctcatatgagacattcaaaaaacatatcctcaacctagcaaaagggaaaggtcgcataagtaaaaccaagaaagaatacttattagaagaaagagatataaatagattttcggtacaaaaagactttattaataggaatctagtagacacaagatatgcaacaagagggctaatgaatttactaagatcatacttccgagtaaataatctcgatgtaaaagtcaaatcaattaatggaggattcacatcattcctgcgaagaaaatggaaattcaaaaaagaaagaaacaaaggatataaacatcacgcggaagacgcccttataatagcaaacgcagatttcatcttcaaagaatggaaaaaactagacaaagctaaaaaagttatggaaaatcagatgttcgaagaaaaacaagctgaatcaatgccagagattgaaacagaacaagaatataaagaaatcttcatcacaccccatcaaatcaagcacataaaagatttcaaagactacaaatattcacacagagtagataaaaaacccaatagagaactcataaacgatacattatattcaacaagaaaagacgacaaaggaaatacactaatagtaaacaaccttaatggactttacgataaagacaacgataaactaaaaaaactaataaacaaatcccctgaaaagttattaatgtatcatcacgacccccaaacataccaaaaactcaaactaataatggaacaatatggagatgaaaaaaacccactatataaatattacgaagaaactggaaactacttaacaaaatatagtaaaaaggataacggaccagtcataaaaaaaataaaatattatggaaataaactcaatgcacatctagatattacagacgactatccaaactcgagaaataaagtagtcaaattatcactaaaaccataccgatttgacgtttatttagataacggggtatataaattcgtaaccgtaaagaatctagatgtcataaaaaaagaaaattattacgaagtgaactcaaaatgctacgaagaagccaagaaactaaaaaaaatatcaaaccaagccgaattcatagcaagtttctataacaacgacctgatcaaaataaacggagaactatatagagtaataggcgtaaacaacgaccttttaaacagaatagaagtaaatatgatagatatcacgtacagagaataccttgaaaacatgaacgataaaagacccccaagaataataaagactatcgctagcaaaacgcaaagcatcaaaaaatactcaacagatatcttaggaaacctctacgaagtcaagtctaaaaaacatccacagataatcaaaaaaggaaagcgcccagctgccacaaaaaaagctggacaagccaagaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9821 - RNA, 4861 nt, synthetic construct
  misc_feature 1..4861: note = Cas9 variant mRNA product
  source 1..4861: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtcggcatacatggagtgccagcagccctatttaataaatgcatcataatatcaattaacttagacttcagcaataaagaaaaatgcatgacaaaaccttacagtataggattggacatcggaacaaattcagtaggatgggcggtaataacagacaattataaagtgccgagcaagaaaatgaaagttcttggcaacacaagcaagaaatacatcaagaaaaacctactaggagtcttgctttttgattcaggcatcacagcagaaggtcgaagactaaaaagaacagcgagacgaagatacacccgacgcagaaatagaatcttatacctacaagaaatcttcagcactgaaatggcaaccttagacgacgcattctttcaacgacttgacgatagcttcctagtaccagatgataaaagagattccaaatatccaatcttcggcaacttagtagaagaaaaagtataccacgacgagttccccacaatttatcacttacgaaaatatctagcagatagcaccaagaaagcagacctgagactcgtctacctagctctggcgcatatgataaaatatagaggccatttcctaatagaaggagaatttaatagcaaaaacaacgacatacagaaaaatttccaagatttcttagacacatataacgcaatctttgaaagtgatttaagcctagaaaatagcaaacaattagaagaaatagtgaaagacaaaataagcaaactagagaagaaagacagaatattgaaactattccccggtgagaaaaactctggaatctttagcgagttcttaaaattaatagtagggaaccaagcagattttaggaaatgttttaaccttgacgaaaaagctagtttacatttttcaaaagaatcatacgatgaagatctagaaaccctattaggatatattggagatgattactcagacgtattcctgaaagcaaagaaattatatgacgcaatactactcagtggattccttacagttacagataatgaaaccgaagcacccctatcaagcgcaatgataaaaaggtataatgaacacaaagaagacctggcactacttaaagaatatatacgaaacatctcattaaaaacttacaatgaagtttttaaagatgatactaaaaatggctatgctgggtatatagacggaaaaacaaatcaagaagacttttatgtctatctcaaaaacctactagcagaatttgaaggtgcagattactttttagagaaaatagatagagaagactttctaagaaaacaaagaacctttgacaacggatcgatcccatatcaaatacatctccaagaaatgagagccatattagacaaacaagcaaaattctatccgttcctagccaaaaataaagaacgtatagaaaagatactaacttttagaataccttactacgtaggaccattagcccgaggaaactcagacttcgcttggagcattcgaaaaaggaacgagaaaattactccatggaacttcgaagacgtcattgataaagaatcgtccgctgaagcattcataaacagaatgacatctttcgacttatatttaccagaagaaaaagttctccccaaacattcactcttatacgaaacatttaacgtatacaacgaactaacaaaagtacgcttcatagcagaatccatgagggattatcaattcctagacagcaaacaaaagaaagatattgtaagactatattttaaagataaacgtaaagtaacagataaagacataatagaatacctccatgctatctatgggtacgatggaatagaattgaaaggaatcgaaaaacaattcaactcatcattatcaacatatcatgatctactaaacataataaatgacaaagaatttctagatgattcttcaaacgaagcaataatagaagaaatcatacacacattaaccatttttgaagacagagaaatgataaaacaacgcctatctaaatttgaaaacatattcgacaaatcggtactcaagaaactaagcagaagacactatacaggatggggaaaattaagcgcaaaactaatcaacggcattcgtgatgaaaaatcaggcaatactatattagactaccttatagatgacggcatatcaaacagaaatttcatgcaattgatacacgatgatgccctcagcttcaaaaagaaaatccaaaaagctcaaattataggagatgaagacaaaggaaatattaaagaagttgtaaaaagtcttccgggaagtcctgccataaagaaaggcatactacaatcaattaaaatagttgatgaattagttaaagtaatgggaggacgcaaaccagaatcaatagttgtggaaatggcacgagaaaaccaatatactaaccaaggtaaatcaaacagtcaacaaagactaaaacgcctagagaaaagcctcaaagaattaggatcaaaaatattaaaagaaaacatcccagccaaacttagtaaaatagacaacaatgcgttacagaacgacagactatacttatactaccttcaaaatggaaaagacatgtacacaggagatgacctagatatagacagattatcaaattacgacatagaccatattattccacaggctttcttaaaagataactccatagataataaagtattagtaagctcagctagcaatagaggaaagagtgacgatttcccatccctagaagtcgttaagaaaagaaaaactttttggtaccaattgttaaaaagtaaactcataagccaaagaaaatttgataacctcacaaaggcagaaagaggaggacttttacccgaagataaagctggttttatacaaagacagctagttgaaacacgccaaataacaaaacacgtagcgagactcctggatgaaaaatttaataataagaaagacgaaaacaaccgggctgtcaggactgtaaaaatcatcaccctaaaatcaaccttagttagtcagtttcggaaagatttcgaactgtataaagtaagagaaataaacgatttccatcatgcacacgatgcgtatttaaatgctgtgatagcatcagcattactcaagaaatatccaaaactagaaccggaatttgtatatggagattaccccaaatacaacagttttcgcgaaagaaaatcagcaacagaaaaagtatacttttactctaacattatgaacatttttaagaaatctataagcctggcagatggaagagtaatagaaagacccttaatagaagtgaacgaagaaacaggagaaagcgtatggaacaaagaaagtgacttagcaacagtcagaagagtgctaagttacccacaagtaaacgtagttaagaaagtcgaagaacaaaatcacggactggacagagggaaacctaaaggcttatttaacgccaatctttcctcaaaacctaaaccaaattccaatgaaaacctagtcggtgctaaagaatacctagaccctaagaaatacggtgggtacgcaggaatatcaaatagcttcgctgttttagtgaaaggaacaatagaaaaaggagccaaaaagaaaataacaaacgtgcttgagttccaaggaataagtatactagatagaataaactaccgaaaagataaactgaacttcttgctagagaaaggatacaaagacatcgaactcatcatagaattacccaaatattccttgtttgaactatcagatgggagtagaagaatgctagcatcgatactaagcacaaacaataaaaggggcgaaatacacaaaggtaatcaaatcttcctctctcagaaattcgtcaaactattatatcacgctaaaagaatctcaaatacaattaatgaaaaccataggaaatacgtagaaaaccacaagaaagagttcgaagaattgttttactatatattagagttcaacgaaaactatgtaggcgctaagaaaaacgggaaactactaaattcagcattccaaagttggcaaaaccatagtattgacgaactatgttcgtcctttatcggccccacgggatcagaacgtaaaggcctattcgaactaacatctaggggttccgctgcagacttcgagttcttaggcgttaaaataccgagatatcgagactacacccccagttccctgcttaaagatgcaacactaatacatcaatcagttacaggactatacgaaactagaatagatttagcaaaattaggagagggcaaaagaccagcagccactaaaaaggctggacaggccaagaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9822 - RNA, 3937 nt, synthetic construct
  misc_feature 1..3937: note = Cas9 variant mRNA product
  source 1..3937: mol_type = other RNA
gggagagtccgctcagccaggttgcagaagcggcttagcgtgtgtcctaatcttctctctgcgtgtaggtaggcctgtgccgcaaacaagcttaccatggcgccaaaaaaaaaaagaaaggtgggaatacacggggtaccagcagcatggtatgcttccttaatgtcagctcaccacttaagagtaggaatagacgtaggaacacatagtgtaggattggcaacacttagggtagacgatcatggaactccaattgaactactaagcgcattgtcacatattcatgactcaggagttggtaaagagggtaagaaagaccacgacaccagaaaaaaattatcaggaatagcacggagagcgagaaggcttctacatcacagacgaacccaattacagcagctagacgaagtacttcgggacttaggctttcccatcccaacgccaggtgaattcttagacttgaacgagcaaacagatccatatcgagtttggcgagttagagcaaggcttgtggaagaaaaattacccgaggaattaagaggtcccgctataagtatggcagtaaggcatatagctcgacatcgaggctggaggaacccttattcaaaggtagaaagcctactcagtcccgcagaagaatcaccatttatgaaagcactcagagaaagaatattggcaacaacaggtgaagtacttgacgacggcataacccccggtcaagcgatggcacaagtagcattaactcataatataagtatgcgtggcccggaaggaattttaggaaaactacatcaatctgacaacgcaaatgaaatacgaaaaatatgcgctagacaaggcgtatcacctgatgtatgtaaacaactacttcgagccgtgttcaaagccgattcaccaagaggaagcgctgtttcacgggtagcgccagatccattaccaggacaaggcagctttagacgggctccaaaatgcgatccagaatttcaaagattcaggattatatcaatagtagcaaatctgcgaatatcggaaacaaaaggagaaaaccgaccgttgacggcggatgaaagacgtcacgtagtaacctttcttaccgaagattcacaagcagacctaacttgggtagatgtagcagaaaaattaggggttcaccgtcgtgatttgaggggcacggccgtacatactgacgacggagaaagatccgcagctagaccgcctatagatgcaaccgacagaataatgagacaaacaaaaattagtagcttaaaaacatggtgggaagaagcagacagtgaacaaagaggagctatgatccgctatttatatgaagatccaacggactcagaatgtgccgaaattatagcagaattaccagaagaagatcaagcaaaactcgacagcttacatttaccagcaggacgggcagcatattcaagagaatcacttactgcattaagcgatcacatgttagctacaacagatgatttacatgaggccaggaaaagattattcggagttgatgatagctgggcccccccggcagaagctataaatgcccccgtaggaaatccatcggttgatagaacacttaaaatagtaggtagatacctcagtgcagtagaatcgatgtggggaacaccagaagtaattcatgtagaacatgtaagagatggcttcacaagcgaaagaatggcagatgaaagagataaagcaaatagacgacgatataatgataatcaagaagcaatgaaaaagatccagagagactatggaaaagaaggatacataagccgcggggacatagtacgtttagatgcactcgaattacaagggtgtgcatgcctatactgcggaaccaccattggctatcacacatgccaacttgatcatatagtaccacaagcaggtccaggatcaaataatagaaggggaaatttagtagcagtttgtgaaagatgtaatagatcaaagtctaacaccccttttgcggtatgggcacagaaatgtggcattccacatgtaggagtcaaagaagcaataggtagagtacgaggttggcgaaaacaaacgccaaatacaagtagtgaagatttaaccagacttaagaaagaagttatagcaagactaaggaggacacaagaagatccagaaatcgatgaaaggtcaatggaaagtgtagcatggatggctaatgaattacatcaccgaatagcagcagcataccctgaaaccacagtaatggtttatagaggatccataaccgcagcggcaagaaaagctgcaggaatagacagtcgaataaatctgataggcgaaaaaggaagaaaagacagaatcgacaggcgtcaccatgcagtagatgcatcagttgtagctctaatggaagcttcagtagcaaaaacgctggcagaacgatcatctttacgaggtgaacagcgactaacaggaaaagaacagacttggaaacaatatacagggtctaccgtaggcgcccgcgaacatttcgaaatgtggagaggacatatgttacacctaacagaattattcaatgaacgtctagcagaagataaagtatatgtaacacagaatataagattacgactgagcgatggcaatgctcacactgttaatccgtccaaattagtaagtcatagactcggcgatggactaacagtacaacaaatagatagagcctgtactccagccctatggtgtgccttaacaagagaaaaagattttgacgaaaagaatggtctaccggctcgtgaagatagggcaataagagttcacggacatgaaataaaatcgagtgattatatacaagttttttctaaacgtaaaaaaactgacagcgatagagacgaaacaccatttggagctatagcggtaagaggcggatttgttgaaataggaccttcaatacatcacgcaagaatatacagggtagagggcaagaaacccgtgtacgctatgcttagagtatttactcatgaccttttaagccaacgtcatggggatctgtttagtgccgttatcccaccacaatccatatccatgaggtgcgcagaaccaaaattaagaaaagcaataacaactggcaatgcaacatatctaggatgggtagtggtaggagatgaattagaaataaatgttgattcgtttacaaaatatgcaataggacggtttttagaagacttccctaatactacacgatggcgcatatgtggatatgataccaacagcaaacttactttgaaaccgatcgtgttagcggcagaaggcttagagaatccttcaagcgctgttaacgaaattgttgaattaaaaggatggagagtcgctataaacgttttaacaaaagttcatccaacagtagtaagaagagatgctttgggtcgaccaagatactcgtcaaggtctaacctaccaacttcatggaccatagagaaaagaccagcagcgacgaaaaaagccggccaagcaaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9823 - RNA, 4798 nt, synthetic construct
  misc_feature 1..4798: note = Cas9 variant mRNA product
  source 1..4798: mol_type = other RNA
gggagagtccgctcagccaggttgcagaagcggcttagcgtgtgtcctaatcttctctctgcgtgtaggtaggcctgtgccgcaaacaagcttaccatggctccaaagaagaaaaggaaagtaggcatacacggagtaccagctgcaaccaaaccatatagtatcggcctagatattggaaccaacagtgttggatgggctgtaacgacagataactataaagtaccttcaaaaaaaatgaaggtacttggtaatacatcaaagaagtatataaaaaaaaacctacttggggtcttgttatttgactctggcataacagcagaaggaagaagactaaagagaacagcccggcggagatacactagaagaagaaatagaatcctatacttacaagaaatattctcaaccgagatggctaccctagacgatgcattttttcaacgattagacgatagtttcttagtaccagatgataaacgcgacagtaagtatccaatatttggaaacttagtagaagaaaaagcataccacgatgaatttccaacgatataccatctaagaaaatatttagcggactctacaaaaaaagcagatctacgattagtatacttagcactagcacatatgatcaaatacagaggtcactttttaatagaaggagaatttaacagcaagaacaatgacattcagaaaaactttcaagatttcttagatacctataacgcgatattcgaatccgatttaagtctagaaaattcaaaacaactagaagaaatagtaaaggacaaaatcagtaaattagaaaaaaaagacaggatattaaaactatttcctggtgagaaaaattcaggcatattcagcgaattcctgaaattaattgtcggaaaccaggcggattttcgaaagtgcttcaaccttgacgaaaaagcatcattacatttttcaaaagaaagttatgacgaagatttggaaacgctactaggctatataggagacgactactcagacgtcttcttgaaagccaaaaaattatatgatgcaatcctactttcagggtttctcacagtaactgataacgaaaccgaagcgcccttgagctctgctatgataaagcgatataatgaacacaaagaagatttagccctactaaaagaatatataagaaatatcagtttgaaaacctataacgaggtttttaaagatgatactaaaaacggatatgcaggttacatagatggaaagacaaatcaggaagacttctacgtttacctcaaaaaattactagcagaatttgaaggtgccgactattttttggaaaaaattgatagagaagacttcttacgcaaacagagaacgttcgataacggaagtattccatatcaaatacacctacaagaaatgcgggctatactggataaacaagccaaattttatccattccttgcaaaaaataaagaacgtatagaaaaaatactaacttttagaatcccatattacgtaggaccattagctagaggaaattcagacttcgcctggtcaattcgaaaaagaaatgagaaaataactccatggaattttgaagacgtcatagacaaagaaagctcagccgaagcgtttataaatagaatgacatcctttgacctgtatttaccagaagaaaaggtactaccaaaacactctctactatacgaaacgtttaacgtctacaatgagttaacaaaagtacgcttcatcgcggaaagtatgcgggactaccaattcctcgacagcaaacaaaaaaaagacatagtaagactatactttaaggacaaacgtaaagttactgacaaagatataatagaatatttacatgcaatatatggatatgacggaatagaattaaaaggaatagaaaaacaattcaattctagcctatcaacgtaccacgatcttctgaacataataaatgacaaagagttcctagacgacagctccaatgaggcaatcatagaagaaatcatccataccctaaccatttttgaagatcgtgaaatgatcaaacaaagactgtcgaagtttgaaaacatttttgacaaaagcgtattaaaaaaactcagtagacgacattacacaggatggggtaaactaagtgctaaattaataaatggaataagggatgaaaagtccggtaatacaatactcgactacctaatagatgatgggataagtaatcgaaattttatgcaactaatccatgacgacgcactaagctttaaaaagaaaatacaaaaagcccaaataataggagatgaagacaaaggaaacataaaagaagtagtaaagagcttaccaggaagtccagctataaagaaaggtatcctccagtctataaaaatagtagatgaactcgttaaagtaatgggcggacggaaaccagagagcatcgttgtggaaatggccagagaaaatcaatatacaaatcaaggaaaaagtaattcacaacaaaggctaaaacgactagaaaaatcactcaaagaacttggtagcaagatattaaaagaaaacatcccagcaaaattatccaaaatcgacaataatgcactacaaaatgacagactctatctttattacctacaaaatgggaaggatatgtatactggcgacgatctcgacatagacaggctctcaaactatgacatcgatcatattataccgcaagccttcctaaaagataattccatagataacaaagttctagtaagcagtgctagcaacagagggaaatcagacgacgtcccttcactggaagtcgtcaaaaaacgaaagacattctggtaccagttattaaaatcaaaacttatctcacaaagaaaattcgacaacttgacaaaagcggaacgcggaggcctatcccctgaagacaaagcgggatttattcaacgacaattggttgagactcgacaaattactaaacatgtggcacgactcctcgatgaaaaatttaacaacaaaaaagatgaaaacaaccgagcagtaagaacagtaaagatcataacattaaaaagtacacttgtatcacaattcagaaaggacttcgaactttataaagttcgagaaataaatgacttccaccacgcacacgacgcctacttgaatgcagtagtcgccagcgcattactcaaaaaatatcctaaactcgaaccagaattcgtttacggagattatccaaaatacaactcatttagagaacggaagagcgctactgaaaaagtatacttttattcaaacataatgaacatatttaaaaaatcgatatcattagctgatggtagagtcatcgaacgaccattaatagaagtaaatgaagaaactggtgaatccgtatggaacaaagaatcagacctggcaacagttagaagagttctatcatatcctcaagtaaacgttgtaaaaaaagtagaagagcaaaaccacggcctagatcgaggaaaaccaaaaggcctattcaacgctaacttgtcatccaaaccaaaacctaactcaaatgaaaacttagtaggagcaaaagaatacttagaccctaaaaaatacggcggctacgcggggatcagtaactcgttcacggtattagtcaaaggaaccatcgaaaaaggggccaagaaaaagattacaaatgtgctagaattccaaggaatatccatcttagatagaataaattatagaaaagataaattaaacttccttttagaaaaagggtataaagacatagaactaatcatcgaactaccaaaatactctttatttgaactatcagacggttcacgtagaatgctagcgagtattctcagcacaaataacaaaagaggcgaaattcataagggaaatcaaatttttttgtcccaaaaattcgttaaacttctataccatgcgaaacgaatatcaaacacaatcaacgagaatcacagaaaatatgttgaaaaccacaagaaagaattcgaagaactgttctattatatattagaattcaacgaaaactacgtcggcgcaaaaaagaatggaaagctattgaacagcgcattccagagctggcaaaaccacagtattgacgaactatgttcatcattcattggcccaacaggatctgaacgaaaaggcctattcgagctaactagccggggctctgcagcagatttcgaatttctaggagtaaaaatacccagatatcgagattacacccccagttcactattaaaggacgcaactctaatacatcagtcagtaaccggactttacgaaacgagaatagatcttgctaagcttggcgaaggtaaacgcccagcagcaactaaaaaagcgggacaagcgaaaaagaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9824 - RNA, 3880 nt, synthetic construct
  misc_feature 1..3880: note = Cas9 variant mRNA product
  source 1..3880: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtcggcattcatggagtacctgcagcagcagcatttaaaccaaactcaattaactatattctaggactcgatatcgggatagcatcagtaggttgggctatggtagagattgacgaagaagaaaacccgatcagactaatcgatttaggagtcagggtatttgaaagagcagaagtaccaaaaacaggggactcccttgccatggcacgcagattagctcgaagtgtaagaagattaacacgcagacgagcacaccgactcttgagaacacgccgacttctaaaaagagagggagtactacaggcagctaatttcgatgaaaatggacttatcaaaagtttacctaatacaccttggcaattgagggctgcagccctggatagaaaactaactccactcgaatggtctgcagtattgttacatctaataaaacacagaggttacttaagtcagcgaaagaatgaaggcgaaactgcagataaagaattaggtgcactattaaaaggagtagcaggaaacgcacacgccttacagacaggagattttagaactccggctgaattagccttaaataaatttgaaaaagaaagcggacatattcgaaatcaacggagtgattattcacacactttcagcagaaaagacctgcaagctgaattaatattactatttgaaaaacaaaaagaatttggaaatccacatgtaagcggagggttaaaagaagggattgaaactttattaatgacacaaagaccagccttgagcggtgatgccgttcagaaaatgttaggacattgtactttcgaaccagctgaaccaaaagcagccaaaaacacatacactgccgaaagatttatatggttaactaaattaaataatttgagaatattagaacaagggtctgagcgacctttaacagacaccgaacgtgccacattaatggatgaaccatacagaaaatcaaaactaacctatgcacaagcaagaaaactattaggcttagaagatactgcctttttcaaaggattgaggtatggcaaagacaatgctgaagcaagtacattaatggaaatgaaagcatatcatgcaattagtagggccttagaaaaagagggtttaaaagacaagaaaagcccacttaatcttagcccagaattacaagacgaaattggaacggcatttagtttatttaaaacagatgaggatataaccggtagactaaaagatcgtattcaaccagaaattttggaggcattactcaaacacatctccttcgataaatttgtgcaaataagtctaaaagcattaagaagaatagtgcccctaatggagcaaggaaaaagatatgacgaagcatgtgcagaaatatatggagaccactacggaaagaaaaatactgaagagaaaatatatttacctccgataccggctgacgaaataaggaatcctgtagtgttacgagcgttaagtcaagcaagaaaagtcattaacggtgttgtcagaagatatggaagtccagccaggatacacatagaaacagcaagagaagtcgggaaatcctttaaagatagaaaagaaatcgagaaaagacaagaagaaaaccgaaaagaccgcgaaaaagcagctgcaaaattcagagaatattttccaaactttgtaggagaacccaaaagcaaagacatactaaaacttagattatatgaacaacaacatggcaaatgtttatatagcggcaaggaaataaatctaggtagacttaatgaaaaaggatatgttgagatagatcacgcactaccattttcacggacatgggatgatagtttcaacaataaagtcctagtcttgggaagcgaaaaccaaaacaaaggtaaccaaacaccatatgaatattttaatggaaaagacaatagcagagagtggcaagagttcaaagcgagagtggaaacttcaagattcccacgatcaaagaaacaacgcatattactacagaaattcgatgaagatggatttaaagaaagaaatctgaatgacacaaggtacgtaaacagatttctatgtcagtttgttgccgacaggatgcgacttacgggaaaaggtaagaaacgggtatttgcatcaaacggacaaataaccaacctcttacgagggttctggggactacggaaagtaagagcggaaaacgatagacatcatgctttagatgcagtcgtcgtagcgtgcagtacggtggcaatgcagcagaaaataaccaggttcgtccgatacaaagaaatgaatgcattcgacggaaaaaccatagacaaagaaacaggagaagttctacatcagaaaacacacttccctcaaccatgggagttcttcgctcaagaagtcatgatcagagtatttggtaaacctgatggaaaaccagaatttgaagaagcagatactttagaaaaattaaggacactactagcagaaaaactaagttccagaccagaagctgtacacgaatatgtcactccgttattcgtctcaagggcaccaaaccggaaaatgagtggtcaagggcacatggaaaccgtaaaatcagctaaaagactcgatgaaggagtaagcgtacttagagttccattaacacaactaaaactaaaagatttagagaaaatggtaaatcgagaaagagaaccaaaactctacgaagcactaaaagcacgactagaagcccacaaagatgacccagcgaaggcttttgcggaacccttctataaatatgataaagctggcaatcgtactcaacaagtaaaagcagtgagggtggaacaagtgcaaaagactggagtttgggtaaggaatcataatggcatagcggacaatgccacgatggtcagagtagatgtttttgaaaaaggtgataaatactatttagtcccaatatattcttggcaagtggcaaaaggaatattaccagatagagcggtagtccaaggaaaagatgaagaagattggcaactaattgacgatagttttaactttaagttctcattgcacccaaatgacttagtagaagtaattacaaagaaagccagaatgtttggctattttgcatcatgtcatagaggaaccggaaatataaatataagaatacatgaccttgaccataaaataggtaaaaatggaatactagaaggaataggagtcaaaactgcacttagctttcaaaagtatcagattgatgaactaggaaaagaaatcaggccatgccgactaaagaaaagaccaccggtaagaaaacgaccggcagcaacaaagaaagcgggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9825 - RNA, 4636 nt, synthetic construct
  misc_feature 1..4636: note = Cas9 variant mRNA product
  source 1..4636: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagttggcatacatggggttccagcagcaaaaaaaccatatacaattggactagacataggtacaaattcggtgggatgggccgtcttaacagatcaatacgacctagtaaagaggaaaatgaaaatagccggagacagtgaaaaaaaacaaataaagaaaaatttctggggagtaaggctattcgacgaaggacaaacagcagccgatcgaagaatggccaggactgccaggagacgtatcgaaagaaggaggaatagaatcagctaccttcaaggaatattcgcagaagaaatgagcaaaacggacgcgaactttttttgtaggctcagcgattcgttttacgtagacaatgaaaaaagaaacagtagacatccatttttcgcaaccatcgaagaagaagtagaataccataaaaactacccaacaatttatcaccttcgcgaagagctagtaaacagtagtgaaaaagctgacttaagacttgtatatctggccctagcacatataataaagtatagaggcaactttttaatagaaggagctttagacacacagaatacaagtgtagacgggatctataaacaatttattcaaacatacaatcaggtattcgcatccggaatagaagatggcagccttaaaaaactagaggacaataaagacgtagctaaaatactggtcgaaaaagttacaagaaaagaaaaactcgaaagaatattaaaactttatccaggagaaaaaagtgctggaatgtttgcacaatttatatcattaatagtaggaagcaaaggcaattttcaaaaaccgttcgatcttattgaaaaaagtgacatagaatgtgccaaagatagctacgaagaggacctagagagtctccttgcactaattggtgatgaatacgcagagctattcgtagcagcaaaaaatgcatatagcgcagtagtcttgtcatcaatcataaccgtcgccgaaaccgaaactaacgcgaaattaagtgcatccatgattgaacgattcgacacacatgaggaagatcttggtgaactaaaggccttcatcaaactacatttaccaaaacactatgaagaaatattttcaaatacagaaaaacacggatatgccggatacatagatggtaaaacaaaacaagcagacttctacaaatacatgaaaatgacgttagaaaatatagaaggtgcagattactttatcgctaaaatagaaaaagaaaatttcctgcgtaaacaaagaacttttgataacggagcgataccacatcaactacacttagaagaattggaagctattctacaccaacaagcaaaatactatccatttttaaaagaaaactatgacaaaatcaaatcattagtaaccttcagaattccttactttgttggaccccttgcaaacggacaaagcgaatttgcatggttaacaagaaaagcggacggggaaataaggccatggaacatcgaagaaaaagtagactttggaaagtcagcagtagactttatagaaaaaatgacaaataaggacacttatctaccaaaagagaatgtcttaccaaaacatagtctatgctatcaaaaatatctggtatacaacgaactcactaaagtaagatacatcaacgaccaagggaaaacatcatacttttcgggacaagagaaagaacaaatattcaatgacctctttaaacaaaaaagaaaagttaaaaaaaaagatctagaactattcctgaggaatatgtcacacgttgaaagtccaacaatagagggcttagaagactcctttaattcatcgtactcaacatatcatgatctcctaaaagttggtataaaacaggaaatactcgacaaccccgtcaatacagaaatgttggaaaatatcgtcaaaatactaacagtattcgaagacaaaagaatgataaaagaacaattacaacagtttagtgatgtattagacggagttgtattgaaaaaattagaaagacgccactacacaggatggggaagattgagtgcaaaacttctaatgggcattagagataaacagagtcatttgacgattttagattacttaatgaacgacgacggactaaacaggaatttaatgcaactaataaacgacagtaacctttcatttaagtcaattatagagaaagaacaagtgacaaccgcagacaaagatatacaaagcattgtagcggatctagcaggtagccctgcgatcaagaaaggaatcttacaatcattgaagatagtagatgaactggtcagtgtgatgggatacccaccacaaactatagttgtagaaatggctcgcgagaatcaaactaccggtaagggaaagaataacagcagacccagatacaagagtctagaaaaagctataaaagaatttggatcacaaatattaaaagaacatccaacagacaatcaagaactaagaaacaatagattatatttatactatttacaaaacggcaaagacatgtatactggccaagacttagatatacacaacttatcaaattatgatatagaccacattgtaccgcaatccttcataaccgataattctatcgacaatttagttttgacaagcagtgcaggaaaccgcgaaaaaggagacgatgttcctccccttgaaatcgttagaaaaagaaaagtattttgggagaaactttatcaaggaaacttaatgtcaaaaaggaaattcgactatcttaccaaagcagaaagaggaggtctcacagaagctgataaagcacggttcatacatcgacaattagtcgagacaagacaaataaccaaaaacgtagctaatatcttgcaccaaagattcaattatgaaaaagacgaccacggaaacactatgaaacaagtaagaatagtaactttaaaatccgcactggtttcacaattcaggaaacaatttcagctatataaagtaagagatgtaaatgactatcatcacgctcacgatgcatatttaaatggtgtagtcgcaaatacgttattaaaagtgtacccacaactggaacctgaatttgtctatggtgactaccatcaattcgactggttcaaagcgaacaaagccacggcaaaaaaacaattctacacaaacatcatgcttttcttcgcacagaaagatagaataatagatgaaaatggagaaatattatgggataagaaatacttagacacagtcaagaaagtaatgagttacaggcaaatgaatatagttaaaaaaacagaaatacaaaaaggcgaatttagtaaagctaccataaaacctaaaggtaattcatcaaaacttataccccgtaaaacgaattgggatccaatgaaatacggaggactagactcaccaaatatggcctacgctgtagtcatcgaatatgcaaaaggaaaaaataaactcgttttcgaaaaaaaaataataagggtgacaataatggaaagaaaagctttcgaaaaggatgaaaaagcattcctagaagaacagggatatagacaacccaaagttctagcaaaattgccaaaatacacactatacgaatgcgaagaaggacgtaggcggatgttagcatcagcaaacgaagcacaaaaaggaaatcaacaagttctacccaaccacttagtaactcttcttcatcatgcagccaactgcgaagtcagtgacggaaaatccctggactacatcgaatcaaacagagaaatgtttgctgaactcctagcccacgtaagtgaatttgctaagagatacactctagcggaagcaaatttgaataagataaatcaactatttgaacaaaacaaagaaggcgatattaaggctattgcacaatcattcgtagatcttatggcatttaacgcgatgggtgctccggcaagcttcaagttcttcgaaacgacaatagaaaggaagagatacaacaacctaaaagaattacttaattccacaataatctatcaaagtataacgggcctatatgaaagcagaaaacgtcttgatgataaacgacctgcggcaactaaaaaagcggggcaagctaagaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9826 - RNA, 4669 nt, synthetic construct
  misc_feature 1..4669: note = Cas9 variant mRNA product
  source 1..4669: mol_type = other RNA
gggagagtccgctcagccaggttgcagaagcggcttagcgtgtgtcctaatcttctctctgcgtgtaggtaggcctgtgccgcaaacaagcttaccatggcgcctaaaaagaaaaggaaggtcggcatacatggagtacctgcagcaaaaaaaccctacagtataggattggatataggaacaaattctgtaggatgggcagtagtaaccgacgactacaaggtaccagcaaaaaaaatgaaagtactcggaaatacagacaaatcacatatagagaagaacttgctaggagctttgttgttcgatagcggaaacacagctgaagacagaaggttaaaaaggacagcccgacgacgatacactagaagacgaaatcgaattttatacttgcaagaaatcttctccgaggaaatgggcaaagtagacgatagtttcttccataggcttgaagattcattcctagtgactgaagataaacgtggggaaaggcatccgatattcggaaatcttgaagaagaagtaaaataccacgaaaactttcccactatatatcacttgaggcaatatctggccgataatcccgaaaaagtagacctgagactagtatatctcgcactagcacatataataaaatttagaggccatttcttaatagaaggtaagtttgacacgcgaaacaatgatgtacaaagattattccaagaatttttagccgtatacgataacacatttgaaaacagtagcttacaagaacaaaacgtccaagtagaagaaatacttacagataaaataagcaaatctgcaaaaaaggaccgggttctaaaactgtttcccaacgaaaaatctaacggaaggtttgcagaatttctcaaattgatcgtaggaaaccaagcagacttcaaaaaacactttgaactagaggaaaaagcaccactacagtttagtaaagatacctatgaagaagaactagaagtgttattagcccaaatcggagacaattacgctgaactgtttttatcagccaagaagctatacgatagcatactcctatcaggaatactaacagtaacagatgtaggcacaaaagcaccattgagtgcatccatgatacaacgctataatgaacatcaaatggacttagctcaattaaaacaattcataagacaaaaattatcagacaaatacaacgaagtattcagcgatgtatcaaaagatggatatgccggctatatagacggaaaaaccaatcaagaagcgttttacaaatatctaaaaggattactaaataaaatagaaggatcaggatacttcctagacaaaattgaacgggaagacttcttgcggaaacagagaacatttgataacggctcaatacctcatcaaatacacttgcaagagatgcgagcaataatccgacgccaagcagaattctatccatttttagcagataatcaagaccggatagaaaaactattaacattcaggattccatactatgtaggacccttagctagaggaaaaagcgatttcgcatggctaagtagaaaaagcgcagataaaatcaccccttggaatttcgacgaaatagtcgacaaagaatcatcagcagaagcgtttattaatagaatgactaactacgacttatacctcccgaatcaaaaggtactaccaaaacactccctcctctacgaaaaattcacagtctataacgaactaactaaagtaaaatataaaactgaacaaggcaaaaccgcattcttcgatgctaatatgaaacaagaaatattcgatggcgtattcaaagtctatcgaaaggttaccaaggacaaattaatggatttcctagaaaaggaattcgacgagttccgaatagtagatctcaccggattagacaaagaaaacaaagtatttaatgcatcatatggcacataccatgacctctgtaagattctagacaaagactttctcgataattcaaagaatgaaaaaatcctagaggacatagtactaacactcactctcttcgaagacagagaaatgataaggaaaaggttagaaaactacagcgacttactaactaaggagcaagtaaagaaactagaacgaagacactacacgggatggggacggctatcagcagaattaattcacggcatcagaaataaagaatctcgcaaaacaatcctggactatttaatagacgatggcaattctaataggaattttatgcaactgataaacgacgatgcactctcatttaaagaagaaattgctaaagcacaggtaataggtgaaacagataacctgaatcaagtagtatcagacatagctggatcaccggcaataaaaaaaggcatcctacaatctcttaaaatagtagacgaattagtaaaaattatgggccatcaaccggaaaatatagttgttgaaatggcaagggaaaatcaattcactaaccaaggacgaaggaactcacagcaacgacttaaaggactgactgactccataaaagagttcgggagccaaatcctaaaagaacacccagtcgaaaacagccaactccaaaacgatagattattcttatactacctgcaaaacggaagggacatgtacacaggagaagaactggatatcgactatttaagtcaatatgacattgatcacataatccctcaagcttttattaaagataactcaatagacaatagagttctgacttcgtccaaagaaaacagagggaaaagcgatgacgtaccaagtaaggacgtcgtccgaaaaatgaaatcatactggagcaaactattatcagcaaaactaataacacaacggaaatttgacaaccttacaaaagccgaacgtggcggcctcacggatgatgataaagcgggattcattaaaagacaacttgtagaaacacgacaaataacaaagcacgttgcaagaatacttgatgaaagattcaacacggaaacagacgagaataacaagaaaataaggcaagtcaaaatagtaacactgaagagtaacctcgtctcaaactttagaaaagaattcgaactctataaggtacgagaaatcaatgactatcatcatgcacatgatgcatacctaaatgctgtaataggaaaagccttattgggagtatatccacaactagaaccagaattcgtatatggtgactatccacacttccacggacataaggagaataaagctacagcgaagaaattcttttattcaaatatcatgaatttcttcaaaaaagatgacgtaagaaccgacaaaaatggcgaaataatatggaaaaaagacgaacacatatcaaatatcaaaaaagtcttatcatatccacaagtaaatattgtcaaaaaagtagaagaacaaaccggaggatttagtaaagaatccatattacctaaaggtaactcagacaaactaattcctagaaaaacaaagaagttttactgggacacgaagaagtatggcggtttcgacagtccaatagtagcctattcgatactcgtaatagcagacatagaaaagggaaaaagtaaaaagttaaaaacagtcaaagcgctagtcggagttacaataatggaaaaaatgacatttgaacgagacccagttgcattcttggaacgaaaaggatacagaaatgtacaggaagaaaacataatcaagcttccaaaatacagcctatttaaactagaaaatggacggaaacgattgttggcctcagcaagagaattgcaaaaaggaaacgaaattgtactaccaaaccacttagggacacttttgtaccacgctaaaaatatacacaaagtcgacgaaccaaaacacctagactacgtagataaacataaagacgaatttaaagaacttctagacgtcgtctctaatttctccaaaaaatacactctcgctgaagggaacctagagaaaataaaagaattatatgcacagaataatggagaagacttaaaagaactagcatctagtttcataaatctattaacatttactgcaattggagcaccagcaacattcaaattcttcgacaaaaacatagacagaaagagatacacttcaacaacagaaatattaaacgcaacattaatccaccaatcaataactgggctatacgagacccgaatagacctaaataagttagggggcgacaaaagacctgcagcgactaaaaaagcgggacaagcgaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9827 - RNA, 3802 nt, synthetic construct
  misc_feature 1..3802: note = Cas9 variant mRNA product
  source 1..3802: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaaggaaagttggtatccatggcgtgccagcagcccaaaccacaaatctaagttacatactaggcctcgacctaggaatagcaagcgtaggttgggcggtcgtcgaaattaacgaaaacgaagaccctattggactcatagatgtaggagtcagaatcttcgaacgcgcagaagtaccaaaaacaggggaatcactcgccttatcaagaagactagccagatccacacgtagattaataagacgtagagcacaccgactcttactggccaaaagatttctgaaaagagaaggcatattaagcaccatagatctagaaaaaggattacccaatcaagcatgggaattacgagtagccggactagaaagacgcttatccgcaatcgaatggggagcagtactattacacttaataaaacatagaggatatttaagcaaacggaaaaacgaaagccaaaccaataataaagaactaggagcgttattaagtggagtagctcaaaaccatcaattactacagagtgacgactatagaacgcctgccgaattagcactcaagaaattcgcaaaagaagagggacatattagaaatcaacgcggagcatatacacacacatttaacagattagacttattagcagaactaaatctactcttcgcccaacaacatcaatttgggaatccgcattgcaaagaacatatccaacaatacatgacagaattgcttatgtggcagaagcccgctttatcgggtgaagcaattcttaagatgttaggaaaatgcacccacgagaaaaatgagttcaaagccgcaaaacatacatattccgcagaaagattcgtatggctaacaaaacttaacaatcttagaatactcgaagacggagcagaacgagcactaaacgaagaagaaaggcaactgttaattaaccacccctacgaaaaatcaaaactaacatatgcccaagttcgaaagttactcggtttatcagaacaagctatatttaaacacttaagatattcaaaggaaaacgcggaatctgcaacttttatggaattaaaagcctggcatgcaataagaaaggctttagaaaaccaaggcttaaaagacacatggcaagacttagctaagaaaccagatttactggatgaaataggaactgctttttcactatacaaaacagacgaagatatacaacagtatttaacaaacaaagtacccaacagcgtgataaatgcattattagtatcattaaactttgacaaattcatagaattaagcctaaaatcactgcggaaaatcttaccattaatggaacagggtaaaagatatgaccaagcctgtagagagatatatggacaccattatggggaagcgaatcagaaaaccagccaactattaccagcgattcctgcacaagaaataagaaacccagtggtattaagaacactaagccaagctagaaaagtcattaatgccataattagacagtatggaagccctgccagagtacacatcgagactggacgagaactaggcaaaagtttcaaagagagacgagagatacagaaacaacaagaggacaacagaacaaaacgcgaatctgcagtacaaaaattcaaagaactattttccgacttctcatccgaaccaaaaagtaaagacatactaaaattccgattatacgagcaacaacacggaaaatgtctatatagcggcaaagaaataaacatacacagactaaatgagaaaggatatgtagaaattgatcatgccctaccattctccagaacttgggacgactcttttaataataaagtactggtattagcgtcagaaaaccaaaataaaggaaaccagacaccatatgagtggctacaaggtaaaataaattcagaaagatggaaaaatttcgtcgccctagtcctaggctcacaatgttccgccgcgaagaaacaacgcttactcactcaagttatagacgacaacaaattcatagatagaaacctaaacgacacgaggtacatagcccgatttctatcaaactacatacaagaaaacttactcctcgtaggtaaaaataagaaaaatgtttttacaccaaatggccaaataacagcactactacgttcacgctggggcctaataaaagcaagagaaaataacaatagacatcatgccctagacgccatagttgttgcatgcgcaacgccctctatgcaacagaaaataacaaggttcataagatttaaagaagtacatccgtacaaaatcgagaatagatatgaaatggtagaccaagaatccggagaaataataagcccacactttccagaaccatgggcctacttcagacaagaagtcaatataagagtatttgacaatcaccctgataccgtactaaaagaaatgttaccagatcgaccgcaagcaaaccatcaattcgttcaaccattatttgtaagtcgcgcacctactaggaaaatgagtggacaaggacacatggaaacaatcaaaagcgctaaaagattagccgaaggaattagtgtgttaagaatacctctaacacaactaaaacccaacttactcgaaaatatggtaaacaaagaaagagaaccagcactatatgcaggtctaaaagcaaggttggcagaatttaatcaagatcctgcaaaagcattcgcaacccccttctacaaacaaggaggccaacaggttaaagcgataagagtagaacaagttcagaaatccggagtgctagttagagaaaacaacggtgtggccgataacgcgtccatagtcagaaccgacgtatttatcaaaaacaataaattctttctggtacccatatatacatggcaagtagcaaaaggaatcctaccaaacaaagctatagtcgcacataaaaacgaagacgaatgggaagaaatggacgaaggcgccaaatttaaattcagtcttttcccaaacgacttagttgaactaaaaactaagaaagaatatttctttggatattatatagggttggatagagccacgggaaatattagcttaaaagaacacgacggggaaatctctaaaggcaaagacggagtatacagagtaggagtcaaattagcattaagtttcgaaaaatatcaagtagacgaattaggtaaaaacagacaaatatgtagaccgcaacaacgacaaccagttcgaaagagaccagcagcaacaaagaaagcaggacaagcgaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9828 - RNA, 3880 nt, synthetic construct
  misc_feature 1..3880: note = Cas9 variant mRNA product
  source 1..3880: mol_type = other RNA
gggagagtccgctcagccaggttgcagaagcggcttagcgtgtgtcctaatcttctctctgcgtgtaggtaggcctgtgccgcaaacaagcttaccatggcgccaaagaagaaaaggaaagttggcatccatggcgtccctgcagcagcagcatttaaaccaaaccccattaactacatactcggactagatattggcatcgcatcggtcggatgggctatggtagagattgatgaagatgaaaatcctatttgcttaatagacctaggagtaagagtattcgaaagggcagaagtcccgaaaactggagatagtctcgcgatggcacgaagattagcacgctcggtcagaaggctaacccgacgacgtgcccatcgtttgctacgagcaagaagactactaaaaagggaaggcgtactacaagccgccgattttgacgagaatggactgataaagagcttaccaaatacaccatggcagttaagggctgcggctcttgaccgaaaacttacaccattagagtggagcgctgtacttttacatcttataaaacacagaggatacctatcacaacggaaaaacgaaggtgaaacagcagataaagaattaggagccctattaaaaggagtagcagacaatgcgcatgcactacaaacaggcgacttcagaactcctgcagaattagcattaaataaatttgaaaaagaaagtggacatataaggaaccaaagaggagattatagtcatacgttcagtagaaaagacttgcaagcagaattaatcctcctattcgaaaaacaaaaagagttcggaaaccctcatgtaagtggcggtttaaaagaaggcatagaaaccttattgatgacacaacgcccagctctaagtggagacgctgtacagaaaatgttaggccattgcacatttgaaccagctgaacccaaagccgccaaaaacacatatacagcagaaagattcatctggttaaccaaattaaataatttacgaatattagaacaaggaagcgaaagaccattaacagacacagaaagggcaaccctcatggatgaaccatatcgtaaatcgaaattaacatatgcacaagcacgaaaactgttaggattagaagacacagcctttttcaaaggcctgcgatatggaaaagataacgccgaagccagcacactaatggaaatgaaggcctaccatgccatatctcgcgcactcgaaaaagaaggactgaaagacaagaaatctcctctcaacctttctccagaactacaagatgaaatcggtaccgcattttcactatttaaaacagatgaagacataacgggcagactcaaagatagaatacagcccgaaatcttagaagcattactcaaacacataagtttcgataaatttgtccaaatcagcttaaaagcactacgtcgaattgtaccactaatggaacaaggcaaaagatatgacgaagcatgcgcagaaatatatggtgatcattatggcaagaaaaacacagaagagaaaatctacctgccaccgataccagccgatgaaataagaaaccctgtagtattacgagcattaagccaagcaagaaaagttataaacggagtagtgcgacgctacggaagtcccgcacgcattcacatagaaactgcacgggaagtaggaaaatcttttaaagatagaaaagaaatagaaaaacgacaagaagaaaatagaaaagatagagaaaaagcagcagcaaaatttagggaatactttccaaatttcgtaggagaaccaaaaagtaaggacatattaaaattaagattgtatgaacaacagcacggaaaatgtctgtattcaggaaaagaaataaatttaggaagattaaatgaaaaaggatatgtagaaatagatcatgctctcccatttagtagaacttgggatgactcttttaacaacaaagtattagtacttggtagtgaaaatcaaaataaaggtaaccaaactccatacgaatatttcaacggaaaagacaactcacgcgaatggcaggaatttaaggcaagggtcgaaacgtcaagattcccaaggtcaaagaaacagaggatactattacaaaaatttgacgaagacggatttaaagaaaggaaccttaacgatacaagatatgtaaatagattcttatgtcaatttgtagcggacagaatgagattaactgggaaaggcaagaaaagggtattcgcaagtaacgggcaaattaccaaccttttaaggggcttctggggactcagaaaagtacgagccgaaaacgacagacaccatgcattagacgcggtggtagtagcatgttccacagtggcaatgcaacagaaaattacaagatttgtaagatacaaagaaatgaacgcctttgatggaaaaacgatagacaaagaaacgggagaagtactacatcaaaagacacatttcccgcaaccttgggagttctttgcgcaagaagttatgattagagtattcggaaaaccggatgggaaaccagaatttgaagaagcagatacacccgaaaaactacgaacattattagcagaaaaactatcaagtagaccggaagcagtgcatgaatatgtaacgcctttatttgtttcacgagcacctaatagaaaaatgtcaggtcaaggacacatggaaacagttaaatcagcaaaacgactagatgaaggcgtttctgtactaagggttccacttacacaattaaaacttaaagatttagagaaaatggtgaacagagaacgagaaccgaagttatatgaagcattaaaagctcgattagaggcgcacaaggacgatcctgcaaaagcattcgcagaaccattttataaatacgataaagcagggaatagaacacaacaagtaaaagctgtacgagtagaacaagttcaaaagactggagtttgggtacgtaatcataatggcatagctgacaatgccacaatggtaagagtagatgtctttgaaaaaggagacaaatattatctagtaccaatatactcatggcaagttgcaaaaggtattctaccagacagagcagttgttcaaggaaaagatgaagaagattggcaactaatcgatgatagcttcaatttcaaatttagcttgcatccaaacgatctcgtagaagtaataacaaagaaagcaagaatgtttggatattttgcctcctgtcacagaggaaccggtaatatcaatatacgaatccacgatctagatcataaaataggtaagaacggaatactagaggggataggcgtaaaaacagctttaagttttcaaaaataccaaattgacgaactagggaaggaaattagaccctgcagattaaagaaaagaccccctgtaagaaaaagacctgccgcaacaaagaaagcaggacaagctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9829 - RNA, 3886 nt, synthetic construct
  misc_feature 1..3886: note = Cas9 variant mRNA product
  source 1..3886: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaaagaaaagtaggcatacatggtgtaccagcagcaaaatatcatgtaggaatagatgttggtacattttcagtaggcttagcagctattgaagtagacgacgccgggatgccaataaaaacgttaagcctcgtatcccatatacatgacagtggcctggacccagacgagataaaatctgcggtaacacgactagcaagttcaggaatcgcccgacgaactagaaggctttatagacgaaaacgaagacgtttacaacaactcgataaattcatacaacgtcaaggatggccagtaatagagttggaggattatagcgacccactctatccatggaaagttcgagctgaacttgcagcttcttacatcgcagacgaaaaagaaagaggtgaaaaattgtcggtagcacttagacacatagcaagacatagaggatggcgtaacccatatgcaaaagtaagtagcttatatctaccagatggaccatctgatgcctttaaagccatacgcgaggaaatcaaaagagcatccggacaacccgtacctgaaacagcaacagttggccaaatggtaacactatgtgaattaggaacattaaaactaagaggagagggaggcgtcttgagtgcaagactacaacaaagtgattacgcacgtgaaattcaagaaatatgtcgtatgcaagaaataggacaggaactatacagaaaaataattgacgtcgtatttgcagcagagtcaccgaaaggatctgcatctagtcgagtaggtaaagatccattacaacctggtaaaaacagagcactcaaggcttcagatgcattccagagatatagaattgcagcattaataggcaatttacgagtccgggttgatggagagaaaaggatattatccgtagaagagaaaaatctagtatttgatcacctcgtcaatttaacaccgaagaaagaaccagaatgggtaactatagcagaaatattagggatagatagaggtcaactaattggtacagctacaatgactgacgatggggaaagagcaggagcacgtcctccaacacatgataccaatagatctatagtaaatagtagaatagcaccattagtcgattggtggaaaacagcaagtgctttagaacaacatgctatggttaaggcactatcaaacgcagaagtcgacgattttgactcacctgaaggtgcaaaagtacaagcatttttcgccgatcttgacgacgatgtacacgcaaaacttgattcactgcacctaccagtaggtagagcagcatatagcgaagacactctagtcagattaacaagaagaatgctatcagacggtgtagatctttatacagccagattacaagaatttggtatcgaaccttcatggaccccaccgacacccagaattggagaaccagtaggaaatccggcagtagatcgagtattaaaaaccgttagtagatggttggaaagtgcgacaaagacatggggtgctccagaaagagtcataatcgaacatgtcagggaagggttcgtgacggagaaaagggctagagaaatggacggtgatatgagacgtcgagctgccagaaacgcaaaactttttcaagaaatgcaggaaaaattaaacgtacaagggaaacctagtcgagcagacttatggcggtaccaatcggtacaaagacagaattgtcaatgtgcatattgcggaagtccaataacattctcaaactcagaaatggatcacatagtaccaagagcaggtcaaggatctaccaatacgagagaaaatcttgtggcagtgtgccacagatgtaatcagtccaaaggcaatacaccttttgcaatatgggctaaaaatacatctatagaaggagtatcagtaaaagaagctgtagaacgcaccaggcattgggtcacggacacaggcatgagaagtacggattttaaaaagttcactaaagcagtggtagaaagattccaacgagctacaatggatgaagaaattgatgctagatcaatggaatcagtagcatggatggcaaacgaattaaggagcagagtagcacaacatttcgcatcccacggcactacggtgagggtatatagaggcagcttaacagcggaagcaaggcgagcatctggtataagtggaaaactgaaattctttgacggagtaggaaaatcacgactagatcgtagacaccacgcaattgatgcagcagttatagcttttacatcggattacgtcgcggaaactttggccgtacgctccaacttaaagcaatcacaagcacataggcaagaagcaccacaatggagagaatttacaggtaaagacgcagaacacagggcagcatggagagtatggtgtcagaaaatggaaaaactaagcgccttattaacagaagatctaagagacgatcgtgtagttgtcatgagtaatgtcagactacgtttaggaaacggatcagcacataaagaaacaatcggaaaattatcaaaggtaaagctaagctcacaattatcagtttctgacattgacaaggcttcttctgaagcattatggtgtgcgcttacacgagaaccaggttttgatcccaaagaaggtctacctgcaaatccagaaagacatattagagtaaacggaacacatgtatatgcaggggataatataggcctatttccagtatctgcaggaagtatcgcattaagagggggatatgctgaactaggaagcagctttcatcacgcaagagtatacaaaattacaagtggaaagaaaccagcttttgcaatgcttcgagtttataccattgacctgctaccatacagaaaccaagacctattttcggtagaattaaaacctcaaacaatgagtatgagacaagcagaaaagaaactgagagacgctttagcaactggtaatgccgagtacttaggatggctagttgttgatgatgagctagtagttgacactagcaaaattgcaactgaccaagtcaaagcggttgaagcagaattgggcacaataaggcgatggagagttgacgggttcttctcaccaagcaaattaagattacgacctttacaaatgtcaaaagaaggaataaagaaagaatcagccccagaacttagcaaaataattgaccgtcctgggtggctaccagcagtgaacaaactcttctcagacggtaatgtaaccgttgtacgaagagattctcttggccgcgtacgactagaaagtaccgcacacttgccagtaacatggaaagtacagaaaagaccagctgctacaaagaaagcaggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9830 - RNA, 3586 nt, synthetic construct
  misc_feature 1..3586: note = Cas9 variant mRNA product
  source 1..3586: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaaagaaaagtaggaatacacggtgttcccgcagccgcaagaatactagcatttgacataggaatcagcagcataggatgggccttttcagaaaacgacgaattaaaagactgtggagtaagaatattcacaaaagtagaaaacccaaaaaccggtgaatcgttagcccttcccaggcgtctagccagatcagcaagaaaaaggctcgcacgccggaaagcacgacttaaccacctcaaacacctaatagccaacgaatttaaactaaattacgaggattaccaatctttcgatgaatcattagcaaaagcatataaaggatcattaatatccccctatgaattaagattcagggcactcaatgaactactttctaaacaagactttgcaagagtcatactccacatagcaaaaagacgaggatatgatgacataaaaaattctgacgacaaagaaaaaggcgcaatactaaaagcgataaaacaaaatgaggaaaaactagccaactaccagtcagtaggcgaatacttatataaagaatacttccaaaagttcaaggaaaacagtaaagaatttacaaatgtacgaaacaaaaaagaatcgtacgagagatgcatagcacagtcattcttaaaagatgaactaaaactaatattcaaaaaacaacgggaatttggattctctttttccaaaaaattcgaagaagaagtactaagtgtcgcattttataagcgagctctgaaagattttagccacttagtcggcaactgttccttcttcacagacgaaaaaagagcgccgaaaaactcaccacttgcattcatgttcgtcgcattaactcgaataataaatcttctaaacaacttaaaaaacacagaaggaatactatacacaaaagatgacctgaacgcactattaaacgaagtattaaaaaacggaacattaacgtataaacaaacaaaaaaactactaggcctaagtgacgactatgaattcaagggtgaaaaaggaacatacttcattgaatttaaaaaatataaagaattcataaaagctctaggagaacacaacctaagtcaggacgatctaaacgaaatagcaaaagatataacacttatcaaagatgaaatcaaactcaaaaaagcactagccaaatacgatctcaaccagaatcaaatagattcattgagcaaattggaattcaaagatcacctaaacatttcattcaaagccctcaaactagttacacctctaatgctagaaggtaaaaaatacgacgaagcatgcaacgaacttaatctaaaagtagcaattaacgaagacaaaaaagactttctgcccgcctttaacgaaacctactataaagacgaagtaacaaatcctgtagtattacgagcaatcaaggaatacagaaaagtactcaacgcattactaaaaaaatatggaaaagttcataaaatcaacatagaactcgctagagaagtaggaaaaaaccattcccaaagagccaaaattgagaaagaacaaaacgaaaactataaagccaaaaaagacgcagaattagaatgtgaaaaactaggacttaaaataaacagcaaaaacatattaaaattaaggttattcaaagaacaaaaggaattctgcgcatattcaggagaaaagataaaaatttctgaccttcaagatgaaaaaatgttagaaatagatcacatatatccatattctagaagtttcgatgacagctatatgaataaagtactagtattcacaaaacaaaaccaagaaaaacttaatcaaactccattcgaagctttcggaaatgacagcgccaaatggcaaaaaatagaagtgctagcaaaaaacttaccaaccaaaaaacaaaaaagaattctagacaaaaattataaagacaaagaacagaaaaacttcaaggacagaaacctgaatgataccagatacatcgccagacttgtgctaaactataccaaagactacttagacttcctgcccctatcagacgatgaaaacaccaagttaaatgacacccaaaaaggctcaaaagtgcacgtagaagcaaaatcaggaatgttaactagtgccttaaggcatacatggggattctcagcaaaggatagaaacaaccacctacatcacgcaatagacgcagtaatcatcgcatacgcgaataattcaatcgtcaaagcatttagtgacttcaaaaaagaacaagaatctaatagcgctgaattatatgccaaaaaaataagcgaattagactacaaaaacaagaggaaattcttcgagccattttcgggattcagacaaaaagtactagacaaaatcgacgaaatttttgtaagcaaacccgaacgaaagaaacccagtggggcattacacgaagaaaccttcagaaaagaagaggaattttatcagagttatggaggcaaagaaggagtcctaaaagcactagaactaggaaaaatacgtaaagtaaacggaaaaattgtcaaaaatggcgatatgttcagagtagacatatttaaacataaaaaaacaaacaaattttatgccgtacctatatacaccatggatttcgctcttaaagtactacctaataaagcggtcgctagatcaaaaaaaggagaaatcaaggactggatcctaatggacgaaaactacgaattttgcttcagtctctacaaagactcactaatattgatacaaacaaaagatatgcaagaacctgaattcgtgtattataatgcttttacatcttcaacagtgagcttaattgtctccaaacatgacaacaaattcgaaacactatccaaaaaccaaaaaatcctgttcaaaaacgcaaatgaaaaagaagtaattgcaaaatcaataggaatccaaaatctcaaagttttcgaaaaatacatagtatccgcactaggagaagtcaccaaagcagagtttagacaacgagaagatttcaaaaaaaagaggccagcagcaacaaaaaaagccggacaagcaaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9831 - RNA, 3997 nt, synthetic construct
  misc_feature 1..3997: note = Cas9 variant mRNA product
  source 1..3997: mol_type = other RNA
gggagagtccgctcagccaggttgcagaagcggcttagcgtgtgtcctaatcttctctctgcgtgtaggtaggcctgtgccgcaaacaagcttaccatggctcctaaaaagaaaagaaaagtcggtatacatggagtacccgcagcatctgacctagtactgggacttgacataggaataggcagcgtaggggtcggcatactaaacaaagtaaccggagaaataatacataaaaacagtagaatatttcctgcagcccaagcagaaaataacctagtcaggcgtacaaatcgccaaggacgaaggctcgccagaaggaagaaacacagaagagtaagactcaaccgattatttgaagagtcagggctgataaccgacttcaccaaaatatcaataaacctcaacccttatcaattaagagtaaaaggcctcacagatgagctatcaaacgaggaactattcatagcacttaaaaacatggtaaaacatagaggcatttcatacttagatgacgcctcagatgacggaaattcatcggtaggagattatgcacaaattgtaaaagagaactccaaacaacttgaaaccaaaaccccaggacaaatacaattagaaagataccagacatacggacaactcagaggagacttcacagtagaaaaagacggaaagaaacaccgactgataaatgtcttccctacaagcgcttacaggagtgaagctctcagaatacttcaaacccaacaagaatttaatccacaaatcaccgatgaatttattaatagataccttgagatcttaacgggaaaacgtaaatattaccacggacctggaaacgaaaaatcgagaaccgattatggaagatataggacaagtggagaaacactggataacatcttcggaatactcataggtaaatgcacattctatccagatgaatttagagccgcaaaagccagctataccgcacaggagttcaatttactaaacgatctaaacaatctaaccgtcccaacagaaacaaagaaactatcaaaagaacagaaaaaccaaatcataaattacgttaaaaacgaaaaagcaatgggacctgcaaaactctttaaatacatagcaaaactcctaagctgcgacgtagccgacataaaaggttaccgaatcgataaatcgggaaaagctgaaatccacacatttgaagcatatagaaaaatgaaaacactagaaacacttgacatagaacaaatggatcgggagacattagacaaactcgcctatgtcttaacactaaatacagaaagagaaggaatacaagaggcacttgagcacgaatttgctgacgggagtttctctcaaaaacaagtagatgagctagtacaattcagaaaagcaaattcaagcatattcggaaaaggatggcacaacttttcagtcaaactcatgatggaactgattcccgaactttatgaaacaagtgaggaacaaatgacgatattaacaagactaggtaaacagaaaaccactagcagttcaaataaaaccaaatatatcgatgaaaaattactaactgaagaaatctataatccagtcgtagcaaaatcagtacgtcaagctataaaaatagtaaatgcagcaatcaaagaatacggagattttgataacatagtaatagaaatggcaagagaaaccaacgaagatgatgaaaagaaagctatacagaaaatccaaaaagccaataaagacgaaaaagatgccgctatgctaaaagctgctaatcaatataatggaaaagcagaactgccacactcagtatttcatgggcacaaacaattagcaactaaaataagactatggcaccagcaaggcgaaagatgcctatatacaggaaaaacaatatcaatacatgacctaataaacaacagtaaccaattcgaagtagatcatatacttcccctatcgataacatttgacgattcactagctaacaaagtgctcgtttacgcaacagcaaaccaagaaaaaggccaacgaaccccatatcaagcactcgattcaatggacgacgcctggtcatttcgcgaacttaaagcatttgtccgagaatctaaaacactttcaaacaaaaagaaagaatatttattaacagaagaagacatctcgaaattcgacgttaggaagaaatttatcgaaagaaacctagtcgacactagatacgcaagtcgagtagtcctaaatgcattacaggaacacttccgggctcataaaattgacacaaaagtgtcagtagtccgaggccaattcacatcacaactacgccgacactggggaatagagaaaactagagacacatatcaccaccatgccgtcgatgcactgatcatagccgctagttcacaattaaacttatggaagaaacagaaaaatactctcgtaagttacagcgaagatcaactactagatatcgaaacaggagaattaattagtgacgatgaatacaaagaatcagtattcaaagcaccctatcaacactttgtagatacattaaaaagcaaagagttcgaagatagtatcctattctcttatcaagtagactccaaatttaacagaaaaatctctgacgcaaccatatacgccacacgacaagcaaaagtcggtaaagacaaagcagatgaaacttacgttctagggaaaataaaagatatatacacacaagacggctatgacgctttcatgaaaatatacaagaaagataaatcaaaatttcttatgtacagacatgaccctcaaacattcgaaaaagttatagaacctatcttagaaaactacccaaacaaacaaataaatgaaaaaggaaaagaagtcccatgtaatccatttctcaaatacaaagaagaacacggctacattcgtaaatactccaagaaaggaaatggaccagaaataaaatctcttaaatattacgactccaaattaggaaatcatatagatataacccccaaagactctaataataaagtagttctacaaagcgtaagtccatggcgtgcagacgtctatttcaacaaaacaacaggcaaatatgaaatactcggcctaaaatatgcagacttacaatttgaaaaaggaacaggtacctataaaatatcgcaagaaaaatacaacgacataaagaagaaagaaggagttgatagcgatagtgaatttaaatttacactctacaaaaatgatttactattagtaaaagatactgaaaccaaagaacaacaattatttagattcctatccagaactatgcccaaacaaaaacattatgtagaactcaaaccttacgataaacaaaaatttgaagggggcgaggcactaataaaagtactgggaaacgtagcaaacagtggccaatgtaagaaaggtttaggaaaatccaatataagcatatacaaagttaggacagacgtattaggtaaccaacatataattaaaaacgaaggcgataaacctaaactggacttcaaaagaccagcagcaacaaagaaagccggtcaagccaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9832 - RNA, 4555 nt, synthetic construct
  misc_feature 1..4555: note = Cpf1 variant mRNA product
  source 1..4555: mol_type = other RNA
gggagagtccgctcagccaggttgcagaagcggcttagcgtgtgtcctaatcttctctctgcgtgtaggtaggcctgtgccgcaaacaagcttaccatggcaccaaagaagaaacgaaaagtgggaatacacggagtacctgcagccacacaattcgaaggcttcaccaatctctaccaagtttcaaaaactctccgatttgaactaataccacaaggaaaaacattgaaacacatacaagaacagggcttcatagaagaagataaagctcgcaatgatcattataaagaactaaaaccaataatagatagaatatacaaaacatatgcagaccaatgtctacaactcgttcaactagattgggaaaacctcagcgctgcaatagactcataccgaaaagagaaaaccgaagagacaagaaatgcactgatagaagaacaagcaacatacagaaatgctatccatgattatttcataggaagaactgataatctgaccgatgctatcaacaaacgacatgcagaaatatataaaggcctcttcaaagcagaactgtttaatggcaaagtattaaaacaactggggaccgtaacaaccacggaacacgaaaatgcattactcaggtcatttgacaaatttacaacatacttttcaggtttttacgaaaaccgcaaaaacgtattttcagctgaagatatttctacagccatacctcatagaatagtacaagacaactttcccaaatttaaagagaattgccatatattcactagactcatcacagctgtaccatcactacgcgaacactttgaaaacgttaagaaagccattggaatttttgtatcgacatctatagaagaagtcttctccttccctttttataatcagctactaacacagacacagatcgatttatacaaccaattactaggcggtattagtcgcgaagccggtacagagaaaataaaaggtctaaatgaagtactcaacctggcaattcagaaaaatgacgaaacagcccatataatagcatccttaccacacagattcatacctttatttaaacaaattctatcggataggaatactctatcattcatcctagaagagttcaaatccgacgaagaagtgatacaatcattttgcaaatataaaactcttctcagaaatgaaaacgtccttgaaacagctgaagccctattcaatgaactaaattcaatagatctaacgcacatattcatctcacacaagaaactagaaactatatcatccgccttatgtgatcactgggatacccttcgaaatgccctatatgaaagaaggatcagcgaacttacgggtaaaataacaaaatccgccaaagaaaaagtgcaacgatctttaaaacacgaagacatcaatctacaagaaataatctccgcggctggtaaagaattaagcgaggcttttaaacagaaaacatccgaaatcctatcccatgcacatgctgccctagaccaaccattaccaaccaccctgaagaaacaagaagagaaagaaatcttaaaatcccaattagattcacttctcggtctatatcatctcttggactggttcgcagtagacgaaagtaacgaagtagatccagagttctcagcacgtctaaccggaattaaattagaaatggaaccatcattatcattttataacaaagcaagaaattatgctaccaagaaaccatactcggtagagaaattcaaactaaactttcaaatgcccacactagcatcaggctgggatgttaataaagagaaaaataacggtgcaatactatttgttaaaaacggattatactacctaggaatcatgcctaaacaaaaaggcagatataaagcattatcattcgaacctacagagaaaacctctgaaggatttgacaaaatgtattatgactacttcccagatgccgcaaaaatgataccaaaatgttctacacaactcaaagcagtaactgcccatttccaaactcatacaactccgatattattgtcaaataatttcatagaaccactagaaataacaaaagaaatatacgacttaaataatcctgaaaaagaacctaagaaatttcaaacagcatacgcaaagaaaactggagaccaaaaaggatacagagaagcactttgtaaatggatagacttcactcgcgactttctttccaaatacaccaaaacaactagcattgacctatcctctttaagaccatctagccaatacaaagacctaggcgaatactacgcagaactcaatcctctattatatcatatctcattccaaagaatcgcagaaaaagaaataatggacgctgtagaaacaggaaaactatatctatttcaaatatataacaaagactttgcaaaaggacatcatggaaaaccaaatctgcacacactttattggacaggactttttagcccagaaaatttagcaaaaacatcaataaagctaaacggccaagcagaactcttctatagacctaaatcaagaatgaaaagaatggcacaccgtctaggagaaaagatgttaaataagaaactaaaagaccagaaaacacccattccagacacattatatcaagaattatatgactatgtaaaccaccgcctatcacatgacctatcagatgaagctagagcactgttaccaaatgtaataacaaaagaagtctcacacgaaatcataaaagatcgtcgtttcacatccgacaaattctttttccatgtcccaatcacactgaactaccaagcagcaaattcaccttcaaaatttaatcaaagagtgaacgcatatttaaaagaacatcccgaaactcccatcatcggaattgacagaggtgaaagaaacttaatatatataaccgtaatagactccactggcaaaatcctagaacaaaggtcgctcaacacaatccaacaatttgactatcagaagaaacttgataatcgagagaaagaaagagtcgcagcacgacaagcctggtctgtagtaggtacgataaaagatctcaaacagggatacctatcacaagtcatacatgaaatagtcgatttaatgatccactatcaagcagtcgtcgtcctagaaaacctaaatttcggtttcaaatcaaaacggacaggcatagccgaaaaagcagtatatcaacaatttgagaaaatgcttattgacaaactaaattgtctcgttttaaaagattaccccgccgaaaaagtaggaggagtccttaatccctatcaactaaccgaccaatttactagcttcgctaaaatgggcacacaatccggattcctgttttacgtacctgcaccatacacgtcaaaaatcgatcccctcacgggattcgtcgacccattcgtctggaaaactattaaaaaccacgaaagccggaaacatttcctggaaggattcgactttcttcactacgacgttaaaacgggtgactttatcctccatttcaaaatgaaccgaaatctatcattccaaagaggccttccaggctttatgccggcatgggatatcgtgttcgagaaaaacgaaacacaatttgacgcaaaaggtacacctttcatagcgggaaaacgaatcgtcccagtaatagaaaaccacagatttacaggcaggtacagagacttatatcccgcaaatgaacttattgccctattagaagaaaaaggaatcgtattcagagacggatcaaacatactaccaaaactattagaaaacgacgactcccatgcaattgacactatggtcgccctaatccgatctgttctacaaatgagaaactcaaacgccgcaacaggcgaagactatataaactcaccagtaagagatctgaacggtgtgtgcttcgattctagattccaaaatcctgaatggcctatggatgctgatgcaaacggagcctatcatatagcacttaaaggccaattactacttaaccatcttaaagaatcaaaagatctaaaattacagaacggaatatctaatcaagattggttagcttacatacaggaactaagaaacaaaagacctgctgccactaagaaagccggacaggctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9833 - RNA, 4534 nt, synthetic construct
  misc_feature 1..4534: note = Cpf1 variant mRNA product
  source 1..4534: mol_type = other RNA
gggagagtccgctcagccaggttgcagaagcggcttagcgtgtgtcctaatcttctctctgcgtgtaggtaggcctgtgccgcaaacaagcttaccatggcgcccaaaaaaaaaagaaaagtgggaatacatggtgttccagcagcctccatataccaggaatttgtaaacaaatactcactttcaaaaacactacgattcgaattgatcccacaaggaaaaacactagagaacattaaagcacgtgggctaatactcgacgacgaaaaaagggccaaagactacaaaaaagctaaacagataatagacaaatatcaccaattcttcatagaggaaatactaagctcagtttgtatctcagaggatctgctacaaaattattcagacgtatatttcaaattaaaaaaatcggacgatgacaatctacaaaaagactttaaaagcgcaaaagacacaataaagaaacaaataagtgaatatataaaagattctgaaaaattcaaaaacctattcaaccaaaatctaatagacgcaaaaaaaggacaggaatctgacctaatcctatggctaaaacaaagcaaagacaacggaatcgaattattcaaagcaaattctgatattacagatatagatgaagcgctagagataataaaaagcttcaagggatggactacctactttaagggtttccatgaaaaccgcaaaaatgtatactccagcaatgacatccccacctcaataatttatcgaatcgtagacgataatctaccaaaattcctcgaaaacaaagcaaaatacgaatcattgaaagacaaagccccagaagccataaactatgaacaaataaaaaaggatttagcagaggaactaacctttgacatagattacaagacttcagaagttaaccagagggtcttctcccttgacgaggtctttgaaatcgccaacttcaacaattacttaaaccaatccggaataacaaaatttaatacaattataggtggcaaatttgtgaatggagaaaacaccaaacgcaaaggcataaatgaatacattaatctatacagccaacaaataaatgataaaactctcaaaaaatacaaaatgagcgtactcttcaaacaaatcctaagcgatacagaaagtaaaagtttcgtaatagacaagcttgaggatgattcggatgttgtaaccactatgcaaagcttctatgagcaaatagcagctttcaaaacagtggaagagaaatcaataaaagaaacactatctctattgttcgatgatctaaaagctcaaaaactagacctatcaaaaatctacttcaaaaatgacaaatcactaaccgacctatctcaacaagtattcgatgactacagtgtaataggaacagcagtactagaatacataacacaacagattgccccgaaaaatctagacaacccttcaaagaaagaacaagaactaatagcgaaaaagacagaaaaagcaaaataccttagcctcgaaacaataaaactagccctcgaggaatttaacaaacacagagatatagacaaacaatgcagattcgaagaaatattagcaaactttgcagcaatacccatgattttcgacgaaatagcacaaaataaggataacctagcacagatatcaatcaaataccaaaaccagggaaaaaaagacctcctgcaagcatcagcagaagacgacgtaaaagcgataaaagatctgctagatcaaacaaacaacctattacacaaattaaaaattttccacattagtcaaagtgaagacaaagcaaacatattagataaggatgaacacttctatctagtattcgaggaatgctattttgaactcgcaaacatagtaccattatataacaaaatccgtaattatatcacgcaaaaaccctattcagacgaaaaatttaaattaaactttgaaaattcgacgcttgctaacgggtgggacaaaaacaaagaaccagacaatacggcaatactctttataaaagatgataaatattacttaggcgttatgaacaaaaaaaataacaaaatattcgatgacaaagccattaaagaaaacaaaggagaaggttacaaaaaaattgtgtacaaactattgcctggtgctaacaaaatgctccccaaggtcttcttttcagccaagtctataaaattctacaacccatccgaagacatactccgaatacgaaatcactcaacacatacaaaaaacggaagcccacaaaaaggatatgagaagttcgaattcaacatagaagactgtagaaaattcatcgacttttataagcagtctataagtaaacaccccgaatggaaagactttggatttagattctcagacacccaacgatacaattcaatagatgaattctaccgagaagtggaaaaccagggatacaagttaaccttcgaaaacataagcgaatcatacatagattcagtcgtcaatcaaggcaaactatacctattccaaatatataacaaagactttagcgcatattccaaaggaagacccaatcttcatacattatattggaaagcattatttgacgaaagaaacctacaagatgtagtttataaattaaatggcgaagcagagctattctatcggaagcaatcaattcccaaaaaaataacgcacccagccaaagaagccatagcaaacaagaacaaagataatccaaaaaaggaatcagtgtttgagtatgatttaatcaaagataaaagatttactgaagataaattcttcttccactgcccgattactattaacttcaaaagctctggagcaaacaaattcaacgatgaaataaacctattacttaaggagaaagccaacgatgttcatatactaagcatagatcgaggagaacgacatctagcctactacacgctcgtagacggaaaaggtaatatcataaaacaagacacatttaacataattggaaatgatcgaatgaaaacaaactatcacgacaaactagcagctatagaaaaagaccgcgattcggcacgaaaagattggaaaaaaatcaataacattaaagaaatgaaagaaggttatctatcacaggtagttcatgaaatagctaaattagtaatagaatataatgcaatagtcgtatttgaagatttaaacttcggtttcaaacgcggtcgcttcaaagtagaaaaacaagtatatcaaaaattagaaaaaatgctaatagaaaagctaaactatttagtttttaaggataatgaatttgataaaacaggaggagtattacgcgcctatcaactaaccgcaccgttcgaaactttcaagaaaatgggaaaacagaccggcataatctattatgtaccagcaggatttacatcaaaaatatgtccagtcaccggatttgtaaaccaactatacccaaaatacgaaagtgtatcaaaatctcaggaatttttcagcaaattcgataaaatatgctacaacctagataagggatatttcgaattctcttttgattacaagaattttggcgataaagcagcaaaaggaaaatggacaattgcgtcgttcggaagcagattaataaactttcgtaacagcgataaaaaccacaactgggacacccgagaagtataccccacgaaggaactagaaaaattattaaaagattactcaatcgaatacggacatggagaatgcataaaagcagccatttgcggagaatctgataaaaaattcttcgcgaaattaacatcagtactaaataccatattacagatgcgaaacagtaaaaccggcaccgaactagattacctaatatcacccgtagccgacgtaaacgggaactttttcgactcacgccaagcaccaaaaaatatgcctcaagatgccgatgcaaatggagcataccacatcggactaaaaggcttaatgctattaggacggatcaaaaataatcaagaaggaaaaaaactaaatcttgtaataaaaaacgaagaatatttcgaattcgtccaaaatcgaaataacaaacggccggctgcaactaaaaaagccggacaagctaaaaaaaaaaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 9834 - RNA, 4521 nt, synthetic construct
  misc_feature 1..4521: note = Cas9 variant mRNA product
  source 1..4521: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggacaagaagtacagcatcggcctggacatcgggaccaactccgtgggctgggccgtgatcaccgacgagtacaaggtccccagcaagaagttcaaggtgctggggaacacggaccggcactccatcaagaagaacctgatcggcgccctgctgttcgacagcggcgagaccgccgaggccacccgcctgaagcggaccgcgcgccggcgctacacgcggcgcaagaaccggatctgctacctgcaggagatcttctccaacgagatggccaaggtggacgacagcttcttccaccgcctcgaggagtccttcctggtcgaggaggacaagaagcacgagcggcaccccatcttcgggaacatcgtggacgaggtggcctaccacgagaagtaccccaccatctaccacctccgcaagaagctcgtcgacagcaccgacaaggccgacctgcggctgatctacctcgcgctggcccacatgatcaagttccgcggccacttcctgatcgagggggacctcaacccggacaactccgacgtggacaagctgttcatccagctggtgcagacctacaaccagctgttcgaggagaaccccatcaacgccagcggcgtcgacgccaaggccatcctgtccgcgcggctgagcaagtcccgccggctcgagaacctgatcgcccagctgcccggggagaagaagaacggcctcttcggcaacctgatcgccctgagcctcgggctgacgcccaacttcaagtccaacttcgacctggccgaggacgccaagctccagctgagcaaggacacctacgacgacgacctggacaacctcctggcgcagatcggcgaccagtacgccgacctgttcctcgccgccaagaacctgtccgacgccatcctgctcagcgacatcctgcgcgtgaacaccgagatcaccaaggcgccgctgtccgccagcatgatcaagcggtacgacgagcaccaccaggacctcacgctgctgaaggccctcgtgcgccagcagctgcccgagaagtacaaggagatcttcttcgaccagagcaagaacgggtacgccggctacatcgacggcggggcctcccaggaggagttctacaagttcatcaagcccatcctggagaagatggacggcaccgaggagctcctggtcaagctgaaccgggaggacctgctccgcaagcagcgcaccttcgacaacgggagcatcccccaccagatccacctgggcgagctgcacgcgatcctccggcgccaggaggacttctacccgttcctgaaggacaaccgggagaagatcgagaagatcctgaccttccgcatcccctactacgtggggcccctcgcccggggcaactcccgcttcgcctggatgacgcgcaagagcgaggagaccatcaccccctggaacttcgaggaggtggtcgacaagggcgcctccgcgcagagcttcatcgagcggatgaccaacttcgacaagaacctgccgaacgagaaggtgctgcccaagcactccctcctgtacgagtacttcacggtgtacaacgagctgaccaaggtcaagtacgtgaccgaggggatgcggaagcccgccttcctcagcggcgagcagaagaaggccatcgtggacctgctgttcaagaccaaccgcaaggtcacggtgaagcagctcaaggaggactacttcaagaagatcgagtgcttcgactccgtcgagatcagcggggtggaggaccggttcaacgcctccctgggcacctaccacgacctgctcaagatcatcaaggacaaggacttcctggacaacgaggagaacgaggacatcctggaggacatcgtgctcaccctgaccctgttcgaggaccgcgagatgatcgaggagcggctcaagacgtacgcccacctgttcgacgacaaggtcatgaagcagctgaagcgccggcgctacaccgggtggggccggctcagccgcaagctgatcaacggcatccgggacaagcagtccgggaagaccatcctggacttcctcaagagcgacggcttcgcgaaccgcaacttcatgcagctgatccacgacgactccctgaccttcaaggaggacatccagaaggcccaggtgagcgggcagggcgactccctccacgagcacatcgccaacctggccgggagccccgccatcaagaagggcatcctgcagacggtgaaggtcgtggacgagctcgtgaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaggagcaccccgtggagaacacccagctccagaacgagaagctgtacctgtactacctccagaacggccgggacatgtacgtcgaccaggagctggacatcaaccgcctgagcgactacgacgtggaccacatcgtgccccagtccttcctcaaggacgacagcatcgacaacaaggtcctgacgcggtccgacaagaaccgcggcaagagcgacaacgtgccctccgaggaggtggtcaagaagatgaagaactactggcggcagctgctcaacgccaagctgatcacccagcgcaagttcgacaacctgaccaaggccgagcgcgggggcctcagcgagctggacaaggccgggttcatcaagcggcagctggtggagacccggcagatcaccaagcacgtggcccagatcctcgactcccgcatgaacacgaagtacgacgagaacgacaagctgatccgggaggtcaaggtgatcaccctcaagagcaagctcgtgtccgacttccgcaaggacttccagttctacaaggtccgggagatcaacaactaccaccacgcgcacgacgcctacctgaacgccgtggtgggcaccgccctgatcaagaagtacccgaagctcgagagcgagttcgtctacggggactacaaggtgtacgacgtgcgcaagatgatcgcgaagtccgagcaggagatcggcaaggccaccgccaagtacttcttctacagcaacatcatgaacttcttcaagacggagatcaccctggccaacggcgagatccggaagcgccccctgatcgagaccaacggggagaccggcgagatcgtctgggacaaggggcgggacttcgccacggtgcgcaaggtgctctccatgccccaggtcaacatcgtgaagaagaccgaggtgcagaccggcgggttcagcaaggagtccatcctgcccaagcgcaacagcgacaagctgatcgcgcggaagaaggactgggacccgaagaagtacggcggcttcgactcccccaccgtcgcctacagcgtgctcgtggtcgccaaggtggagaagggcaagagcaagaagctgaagtccgtgaaggagctgctcgggatcacgatcatggagcgcagctccttcgagaagaaccccatcgacttcctggaggccaaggggtacaaggaggtcaagaaggacctgatcatcaagctcccgaagtacagcctgttcgagctggagaacggccggaagcgcatgctcgcctccgcgggggagctgcagaagggcaacgagctggccctccccagcaagtacgtgaacttcctgtacctggcctcccactacgagaagctcaagggcagccccgaggacaacgagcagaagcagctgttcgtggagcagcacaagcactacctggacgagatcatcgagcagatctccgagttcagcaagcgggtcatcctcgccgacgccaacctggacaaggtgctgtccgcgtacaacaagcaccgcgacaagcccatccgggagcaggccgagaacatcatccacctcttcaccctgaccaacctgggggccccggccgcgttcaagtacttcgacaccacgatcgaccgcaagcggtacaccagcaccaaggaggtgctcgacgccaccctgatccaccagtccatcacgggcctgtacgagacccgcatcgacctcagccagctcgggggcgacaagcggcccgccgccaccaagaaggccgggcaggcgaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9835 - RNA, 5304 nt, synthetic construct
  misc_feature 1..5304: note = Cas9 variant mRNA product
  source 1..5304: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9836 - RNA, 3576 nt, synthetic construct
  misc_feature 1..3576: note = Cas9 variant mRNA product
  source 1..3576: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagcggaactacatcctgggcctcgacatcgggatcaccagcgtgggctacgggatcatcgactacgagacccgcgacgtgatcgacgccggcgtccggctgttcaaggaggccaacgtggagaacaacgagggccgccggtccaagcgcggggcccggcgcctgaagcggcgccggcgccaccggatccagcgcgtgaagaagctcctgttcgactacaacctgctcacggaccacagcgagctgtccggcatcaacccctacgaggcccgggtcaaggggctgagccagaagctctccgaggaggagttcagcgcggccctgctgcacctcgccaagcgccggggcgtgcacaacgtgaacgaggtcgaggaggacaccgggaacgagctgtccaccaaggagcagatcagccgcaactccaaggccctggaggagaagtacgtggcggagctccagctggagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaggacatcaaggagtggtacgagatgctgatgggccactgcacctacttcccggaggagctccggagcgtgaagtacgcctacaacgccgacctgtacaacgcgctgaacgacctcaacaacctggtcatcacgcgcgacgagaacgagaagctggagtactacgagaagttccagatcatcgagaacgtgttcaagcagaagaagaagcccaccctcaagcagatcgccaaggagatcctggtgaacgaggaggacatcaaggggtaccgggtcacctccaccggcaagcccgagttcacgaacctgaaggtgtaccacgacatcaaggacatcaccgcccgcaaggagatcatcgagaacgccgagctcctggaccagatcgccaagatcctgaccatctaccagagctccgaggacatccaggaggagctcaccaacctgaacagcgagctgacgcaggaggagatcgagcagatctccaacctcaaggggtacaccggcacccacaacctgagcctgaaggcgatcaacctcatcctggacgagctgtggcacaccaacgacaaccagatcgccatcttcaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctgcccaacgacatcatcatcgagctggcccgggagaagaacagcaaggacgcccagaagatgatcaacgagatgcagaagcgcaaccggcagaccaacgagcgcatcgaggagatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtcgaccacatcatcccccgcagcgtgtccttcgacaacagcttcaacaacaaggtgctggtcaagcaggaggagaactccaagaaggggaaccggacccccttccagtacctgagctccagcgactccaagatcagctacgagaccttcaagaagcacatcctcaacctggccaagggcaaggggcgcatctccaagaccaagaaggagtacctgctcgaggagcgggacatcaaccgcttcagcgtgcagaaggacttcatcaaccggaacctggtggacacgcgctacgccacccggggcctgatgaacctcctgcgctcctacttccgcgtcaacaacctggacgtgaaggtcaagagcatcaacgggggcttcacctccttcctccggcgcaagtggaagttcaagaaggagcggaacaagggctacaagcaccacgccgaggacgcgctgatcatcgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcacatcaaggacttcaaggactacaagtacagccaccgcgtggacaagaagcccaaccgggagctcatcaacgacaccctgtactccacccgcaaggacgacaaggggaacaccctgatcgtgaacaacctcaacggcctgtacgacaaggacaacgacaagctgaagaagctcatcaacaagagccccgagaagctgctgatgtaccaccacgacccccagacgtaccagaagctcaagctgatcatggagcagtacggggacgagaagaacccgctgtacaagtactacgaggagaccggcaactacctcaccaagtactccaagaaggacaacgggcccgtcatcaagaagatcaagtactacggcaacaagctgaacgcccacctggacatcaccgacgactaccccaacagccggaacaaggtggtgaagctctccctgaagccctaccgcttcgacgtctacctggacaacggcgtgtacaagttcgtgaccgtcaagaacctcgacgtgatcaagaaggagaactactacgaggtgaacagcaagtgctacgaggaggccaagaagctgaagaagatctccaaccaggccgagttcatcgccagcttctacaacaacgacctgatcaagatcaacggggagctctaccgggtcatcggcgtgaacaacgacctgctgaaccgcatcgaggtgaacatgatcgacatcacgtaccgggagtacctcgagaacatgaacgacaagcgcccgccccggatcatcaagaccatcgcgtccaagacccagagcatcaagaagtactccaccgacatcctggggaacctgtacgaggtcaagagcaagaagcacccccagatcatcaagaagggcaagcgccccgccgccacgaagaaggccggccaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9837 - RNA, 4644 nt, synthetic construct
  misc_feature 1..4644: note = Cas9 variant mRNA product
  source 1..4644: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgctgttcaacaagtgcatcatcatcagcatcaacctcgacttctccaacaaggagaagtgcatgaccaagccctacagcatcggcctggacatcgggaccaactccgtgggctgggccgtgatcacggacaactacaaggtccccagcaagaagatgaaggtgctggggaacacctccaagaagtacatcaagaagaacctcctgggcgtgctgctgttcgacagcggcatcaccgccgaggggcggcgcctgaagcggaccgcccgccggcgctacacgcggcgccggaaccgcatcctgtacctccaggagatcttctccaccgagatggccaccctggacgacgcgttcttccagcggctggacgacagcttcctcgtccccgacgacaagcgcgactccaagtacccgatcttcggcaacctggtggaggagaaggtgtaccacgacgagttccccaccatctaccacctccggaagtacctcgccgacagcacgaagaaggccgacctgcgcctggtctacctcgccctggcgcacatgatcaagtaccgggggcacttcctgatcgagggcgagttcaactccaagaacaacgacatccagaagaacttccaggacttcctcgacacctacaacgccatcttcgagagcgacctgtccctggagaacagcaagcagctcgaggagatcgtgaaggacaagatctccaagctggagaagaaggaccgcatcctgaagctgttccccggggagaagaacagcggcatcttctccgagttcctgaagctgatcgtgggcaaccaggccgacttccggaagtgcttcaacctcgacgagaaggccagcctgcacttctccaaggagagctacgacgaggacctggagaccctcctggggtacatcggcgacgactacagcgacgtcttcctgaaggccaagaagctctacgacgcgatcctgctgtccgggttcctcaccgtgacggacaacgagaccgaggcgcccctgagctccgccatgatcaagcgctacaacgagcacaaggaggacctggccctcctgaaggagtacatccggaacatcagcctgaagacctacaacgaggtgttcaaggacgacaccaagaacggctacgccggctacatcgacgggaagacgaaccaggaggacttctacgtctacctcaagaacctgctggccgagttcgagggcgccgactacttcctcgagaagatcgaccgcgaggacttcctgcggaagcagcgcaccttcgacaacgggtccatcccgtaccagatccacctccaggagatgcgcgccatcctggacaagcaggccaagttctaccccttcctcgccaagaacaaggagcggatcgagaagatcctgaccttccgcatcccctactacgtgggccccctggcgcgggggaacagcgacttcgcctggtccatccgcaagcggaacgagaagatcaccccgtggaacttcgaggacgtgatcgacaaggagagctccgccgaggccttcatcaaccgcatgacgagcttcgacctctacctgcccgaggagaaggtcctgcccaagcactccctcctgtacgagaccttcaacgtgtacaacgagctgaccaaggtgcggttcatcgccgagagcatgcgcgactaccagttcctcgactccaagcagaagaaggacatcgtccggctgtacttcaaggacaagcgcaaggtgaccgacaaggacatcatcgagtacctgcacgcgatctacggctacgacggcatcgagctcaaggggatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgggagatgatcaagcagcgcctctccaagttcgagaacatcttcgacaagagcgtgctgaagaagctgagccggcgccactacaccggctgggggaagctctccgccaagctgatcaacggcatccgggacgagaagtccgggaacacgatcctggactacctcatcgacgacggcatcagcaaccgcaacttcatgcagctgatccacgacgacgccctgagcttcaagaagaagatccagaaggcgcagatcatcggcgacgaggacaaggggaacatcaaggaggtcgtgaagtccctccccggcagcccggccatcaagaaggggatcctgcagtccatcaagatcgtcgacgagctggtgaaggtgatgggcgggcggaagcccgagagcatcgtcgtggagatggcccgcgagaaccagtacaccaaccagggcaagtccaacagccagcagcggctcaagcgcctggagaagtccctgaaggagctcggcagcaagatcctgaaggagaacatccccgccaagctgtccaagatcgacaacaacgccctccagaacgaccgcctgtacctgtactacctccagaacgggaaggacatgtacaccggcgacgacctggacatcgaccggctgagcaactacgacatcgaccacatcatcccccaggcgttcctcaaggacaactccatcgacaacaaggtgctggtcagctccgccagcaaccgcgggaagtccgacgacttcccgagcctggaggtggtgaagaagcggaagaccttctggtaccagctcctcaagagcaagctgatctcccagcgcaagttcgacaacctgacgaaggccgagcggggcggcctgctgcccgaggacaaggccgggttcatccagcgccagctcgtcgagacccggcagatcaccaagcacgtggcccgcctgctggacgagaagttcaacaacaagaaggacgagaacaaccgggcggtgcgcaccgtcaagatcatcacgctcaagagcaccctggtgtcccagttccggaaggacttcgagctgtacaaggtgcgcgagatcaacgacttccaccacgcccacgacgcctacctcaacgccgtcatcgccagcgcgctgctgaagaagtaccccaagctcgagcccgagttcgtgtacggcgactacccgaagtacaactccttccgggagcgcaagagcgccaccgagaaggtgtacttctactccaacatcatgaacatcttcaagaagtccatcagcctggccgacgggcgggtcatcgagcgccccctgatcgaggtgaacgaggagaccggcgagagcgtgtggaacaaggagtccgacctcgccaccgtccggcgcgtgctgagctacccccaggtgaacgtcgtgaagaaggtggaggagcagaaccacgggctggaccggggcaagcccaagggcctcttcaacgcgaacctgtccagcaagccgaagcccaactccaacgagaacctggtcggggccaaggagtacctcgaccccaagaagtacggcgggtacgccggcatcagcaactccttcgccgtgctggtgaaggggacgatcgagaagggcgccaagaagaagatcaccaacgtcctggagttccagggcatcagcatcctcgaccgcatcaactaccggaaggacaagctgaacttcctgctcgagaaggggtacaaggacatcgagctgatcatcgagctgccgaagtacagcctcttcgagctgtccgacggcagccgccgcatgctggcgtccatcctcagcaccaacaacaagcgcggggagatccacaagggcaaccagatcttcctgtcccagaagttcgtgaagctgctctaccacgccaagcggatcagcaacaccatcaacgagaaccaccggaagtacgtggagaaccacaagaaggagttcgaggagctgttctactacatcctggagttcaacgagaactacgtcggggccaagaagaacggcaagctcctgaactccgccttccagagctggcagaaccactccatcgacgagctgtgcagctccttcatcggccccacggggagcgagcgcaagggcctcttcgagctgacctcccgggggagcgccgcggacttcgagttcctgggcgtgaagatcccccgctaccgggactacaccccctccagcctcctgaaggacgccaccctgatccaccagtccgtgacggggctgtacgagacccgcatcgacctcgccaagctgggcgagggcaagcggccggccgccaccaagaaggcggggcaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9838 - RNA, 3720 nt, synthetic construct
  misc_feature 1..3720: note = Cas9 variant mRNA product
  source 1..3720: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgtggtacgccagcctgatgtccgcccaccacctccgggtgggcatcgacgtggggacccacagcgtcggcctggccaccctgcgcgtggacgaccacgggacgcccatcgagctcctgtccgccctgagccacatccacgactccggcgtgggcaaggaggggaagaaggaccacgacacccggaagaagctcagcggcatcgcgcgccgggcccgccggctgctgcaccaccgccggacccagctccagcagctggacgaggtcctgcgcgacctcgggttccccatccccaccccgggcgagttcctggacctgaacgagcagacggacccctaccgggtgtggcgcgtgcgggcccgcctcgtcgaggagaagctgcccgaggagctgcgggggcccgccatctccatggcggtgcgccacatcgcccggcaccgcggctggcggaacccgtacagcaaggtggagtccctcctgagccccgccgaggagtcccccttcatgaaggccctgcgcgagcggatcctcgccaccaccggcgaggtcctggacgacgggatcacccccggccaggcgatggcccaggtggccctgacgcacaacatcagcatgcgcgggccggagggcatcctcggcaagctgcaccagtccgacaacgccaacgagatccgcaagatctgcgcccggcagggggtgagccccgacgtctgcaagcagctgctccgcgcggtgttcaaggccgacagcccccggggctccgccgtgtcccgcgtcgcccccgacccgctgcccgggcagggcagcttccggcgcgcccccaagtgcgaccccgagttccagcggttccgcatcatctccatcgtggcgaacctgcggatcagcgagaccaagggggagaaccgcccgctcaccgccgacgagcggcgccacgtggtcaccttcctgacggaggacagccaggccgacctgacctgggtggacgtggccgagaagctcggcgtccaccggcgcgacctgcggggcaccgccgtgcacaccgacgacggggagcgctccgcggcccggccgcccatcgacgccacggaccgcatcatgcggcagaccaagatcagctccctgaagacctggtgggaggaggccgacagcgagcagcgcggcgcgatgatccgctacctctacgaggaccccaccgactccgagtgcgccgagatcatcgccgagctgcccgaggaggaccaggccaagctggacagcctccacctccccgccgggcgggcggcctactcccgcgagagcctgacggccctgtccgaccacatgctggccaccaccgacgacctgcacgaggcccggaagcgcctcttcggcgtcgacgacagctgggcgccgcccgccgaggccatcaacgcccccgtggggaacccctccgtggaccggaccctgaagatcgtcggccgctacctgagcgccgtggagtccatgtggggcacgcccgaggtgatccacgtcgagcacgtgcgggacgggttcaccagcgagcgcatggcggacgagcgggacaaggccaaccgccggcgctacaacgacaaccaggaggccatgaagaagatccagcgggactacggcaaggaggggtacatctcccgcggcgacatcgtgcggctcgacgccctggagctgcaggggtgcgcgtgcctgtactgcggcaccaccatcggctaccacacgtgccagctcgaccacatcgtcccgcaggccgggcccggcagcaacaaccgccgggggaacctggtggccgtgtgcgagcgctgcaaccggtccaagagcaacacccccttcgccgtctgggcccagaagtgcggcatcccccacgtgggcgtgaaggaggcgatcgggcgcgtccggggctggcgcaagcagaccccgaacacctccagcgaggacctgacgcgcctcaagaaggaggtgatcgcccggctgcgccggacccaggaggaccccgagatcgacgagcgcagcatggagtccgtggcctggatggccaacgagctgcaccaccggatcgccgcggcctaccccgagaccaccgtcatggtgtaccgcgggagcatcacggccgccgcccggaaggcggccggcatcgactcccgcatcaacctcatcggggagaagggccggaaggaccgcatcgaccggcgccaccacgccgtggacgccagcgtcgtggcgctgatggaggcctccgtggccaagaccctggccgagcggagctccctccgcggcgagcagcggctgaccgggaaggagcagacctggaagcagtacaccggcagcacggtcggggcccgcgagcacttcgagatgtggcggggccacatgctgcacctcaccgagctgttcaacgagcgcctggcggaggacaaggtgtacgtgacccagaacatccggctccgcctgtccgacgggaacgcccacaccgtcaaccccagcaagctggtgtcccaccgcctcggcgacggcctgacggtgcagcagatcgaccgggcctgcaccccggccctgtggtgcgccctcacccgcgagaaggacttcgacgagaagaacgggctgcccgcgcgggaggaccgcgccatccgggtccacggccacgagatcaagagctccgactacatccaggtgttcagcaagcgcaagaagaccgactccgaccgggacgagacgcccttcggggccatcgccgtgcgcggcgggttcgtcgagatcggccccagcatccaccacgcccggatctaccgcgtggagggcaagaagccggtgtacgcgatgctgcgggtcttcacccacgacctcctgtcccagcgccacggggacctgttcagcgccgtgatcccgccccagagcatctccatgcggtgcgccgagcccaagctccgcaaggccatcaccaccggcaacgccacgtacctggggtgggtggtcgtgggcgacgagctggagatcaacgtggacagcttcaccaagtacgcgatcgggcggttcctcgaggacttccccaacaccacccgctggcggatctgcggctacgacacgaactccaagctgaccctgaagcccatcgtcctcgccgccgagggcctggagaaccccagctccgccgtgaacgagatcgtggagctgaaggggtggcgcgtcgcgatcaacgtgctcaccaaggtgcaccccaccgtcgtgcggcgcgacgccctgggccggccgcgctacagctcccgcagcaacctgcccacgtcctggaccatcgagaagcggcccgccgccaccaagaaggccgggcaggcgaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9839 - RNA, 4581 nt, synthetic construct
  misc_feature 1..4581: note = Cas9 variant mRNA product
  source 1..4581: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaccaagccctacagcatcggcctggacatcgggaccaactccgtgggctgggccgtgacgaccgacaactacaaggtccccagcaagaagatgaaggtgctcgggaacacctccaagaagtacatcaagaagaacctgctgggcgtgctcctgttcgacagcggcatcaccgccgaggggcggcgcctgaagcggacggcccgccggcgctacacccggcgccggaaccgcatcctctacctgcaggagatcttctccaccgagatggccaccctggacgacgcgttcttccagcggctcgacgacagcttcctggtccccgacgacaagcgcgactccaagtacccgatcttcggcaacctggtggaggagaaggcctaccacgacgagttccccacgatctaccacctccggaagtacctggccgacagcaccaagaaggccgacctgcgcctcgtgtacctggcgctggcccacatgatcaagtaccgggggcacttcctcatcgagggcgagttcaactccaagaacaacgacatccagaagaacttccaggacttcctggacacctacaacgccatcttcgagagcgacctgtccctcgagaacagcaagcagctggaggagatcgtcaaggacaagatctccaagctggagaagaaggaccgcatcctcaagctgttccccggggagaagaacagcggcatcttctccgagttcctgaagctcatcgtgggcaaccaggccgacttccggaagtgcttcaacctggacgagaaggccagcctgcacttctccaaggagagctacgacgaggacctcgagaccctgctggggtacatcggcgacgactactccgacgtgttcctcaaggcgaagaagctgtacgacgccatcctgctcagcgggttcctgacggtcaccgacaacgagaccgaggcgcccctgagctccgccatgatcaagcgctacaacgagcacaaggaggacctcgccctgctgaaggagtacatccggaacatcagcctcaagacctacaacgaggtgttcaaggacgacacgaagaacggctacgccggctacatcgacgggaagaccaaccaggaggacttctacgtgtacctgaagaagctgctcgccgagttcgagggcgccgactacttcctggagaagatcgaccgcgaggacttcctgcggaagcagcgcaccttcgacaacgggtccatcccgtaccagatccacctccaggagatgcgcgccatcctggacaagcaggccaagttctaccccttcctggcgaagaacaaggagcggatcgagaagatcctgaccttccgcatcccctactacgtcggccccctcgcccgggggaacagcgacttcgcctggtccatccgcaagcggaacgagaagatcacgccgtggaacttcgaggacgtgatcgacaaggagagctccgccgaggccttcatcaaccgcatgaccagcttcgacctgtacctgcccgaggagaaggtgctccccaagcactccctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacatcatcgagtacctccacgccatctacggctacgacggcatcgagctgaaggggatcgagaagcagttcaacagctccctgagcacctaccacgacctcctgaacatcatcaacgacaaggagttcctggacgactccagcaacgaggccatcatcgaggagatcatccacaccctcaccatcttcgaggaccgggagatgatcaagcagcgcctgtccaagttcgagaacatcttcgacaagagcgtgctgaagaagctctcccggcgccactacacgggctgggggaagctgagcgccaagctgatcaacggcatccgggacgagaagtccgggaacaccatcctcgactacctgatcgacgacggcatcagcaaccgcaacttcatgcagctgatccacgacgacgcgctcagcttcaagaagaagatccagaaggcccagatcatcggcgacgaggacaaggggaacatcaaggaggtggtcaagtccctgcccggcagcccggccatcaagaaggggatcctgcagtccatcaagatcgtggacgagctcgtcaaggtgatgggcgggcggaagcccgagagcatcgtggtcgagatggcccgcgagaaccagtacaccaaccagggcaagtccaacagccagcagcggctgaagcgcctggagaagtccctcaaggagctgggcagcaagatcctgaaggagaacatccccgccaagctctccaagatcgacaacaacgcgctgcagaacgaccgcctgtacctctactacctgcagaacgggaaggacatgtacaccggcgacgacctggacatcgaccggctcagcaactacgacatcgaccacatcatcccccaggccttcctgaaggacaactccatcgacaacaaggtgctggtgagctccgccagcaaccgcgggaagtccgacgacgtcccgagcctcgaggtggtgaagaagcggaagacgttctggtaccagctgctcaagagcaagctgatctcccagcgcaagttcgacaacctgaccaaggccgagcggggcggcctgagccccgaggacaaggccgggttcatccagcgccagctcgtcgagacccggcagatcaccaagcacgtggcgcgcctgctggacgagaagttcaacaacaagaaggacgagaacaaccgggccgtgcgcacggtcaagatcatcaccctcaagtccaccctggtgagccagttccggaaggacttcgagctgtacaaggtgcgcgagatcaacgacttccaccacgcccacgacgcctacctcaacgccgtcgtggcgtccgccctgctgaagaagtaccccaagctcgagcccgagttcgtgtacggcgactacccgaagtacaacagcttccgggagcgcaagtccgccaccgagaaggtctacttctacagcaacatcatgaacatcttcaagaagtccatcagcctggccgacgggcgggtgatcgagcgccccctgatcgaggtgaacgaggagaccggcgagtccgtctggaacaaggagagcgacctcgcgacggtgcggcgcgtgctgtcctacccccaggtcaacgtggtgaagaaggtcgaggagcagaaccacgggctggaccggggcaagcccaagggcctcttcaacgccaacctgagctccaagccgaagcccaacagcaacgagaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgaccgcatcaactaccggaaggacaagctgaacttcctgctcgagaaggggtacaaggacatcgagctgatcatcgagctgccgaagtacagcctcttcgagctgagcgacggctcccgccgcatgctggcgagcatcctctccacgaacaacaagcgcggggagatccacaagggcaaccagatcttcctgagccagaagttcgtgaagctgctctaccacgccaagcggatctccaacaccatcaacgagaaccaccggaagtacgtcgagaaccacaagaaggagttcgaggagctgttctactacatcctggagttcaacgagaactacgtgggggccaagaagaacggcaagctcctgaacagcgccttccagtcctggcagaaccacagcatcgacgagctgtgctccagcttcatcggccccaccgggtccgagcgcaagggcctcttcgagctgaccagccgggggtccgccgcggacttcgagttcctgggcgtgaagatcccccgctaccgggactacacgcccagctccctcctgaaggacgccaccctgatccaccagagcgtcaccgggctctacgagacccgcatcgacctggccaagctgggcgagggcaagcggccggccgccacgaagaaggcggggcaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9840 - RNA, 3663 nt, synthetic construct
  misc_feature 1..3663: note = Cas9 variant mRNA product
  source 1..3663: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccttcaagcccaacagcatcaactacatcctgggcctcgacatcgggatcgcctccgtgggctgggccatggtggagatcgacgaggaggagaaccccatccggctgatcgacctgggggtccgcgtgttcgagcgggcggaggtgcccaagaccggcgacagcctcgccatggcccgccggctggcccgctccgtccggcgcctgacccggcgccgggcgcaccgcctcctgcggacgcgccggctgctcaagcgcgagggcgtgctgcaggccgccaacttcgacgagaacgggctgatcaagagcctcccgaacaccccctggcagctgcgggccgccgcgctggaccgcaagctcacgcccctggagtggtccgccgtgctgctccacctgatcaagcaccggggctacctgagccagcgcaagaacgagggggagaccgccgacaaggagctcggcgccctgctgaagggggtcgccggcaacgcgcacgccctccagaccggcgacttccggacccccgccgagctggccctgaacaagttcgagaaggagtccgggcacatccgcaaccagcgcagcgactactcccacaccttcagccggaaggacctccaggccgagctgatcctcctgttcgagaagcagaaggagttcggcaacccgcacgtgtccgggggcctgaaggagggcatcgagaccctgctcatgacgcagcgccccgcgctgagcggggacgccgtgcagaagatgctgggccactgcaccttcgagcccgccgagcccaaggccgccaagaacacctacaccgcggagcggttcatctggctcacgaagctgaacaacctgcgcatcctcgagcaggggtccgagcggccgctgaccgacaccgagcgcgccaccctgatggacgagccctaccgcaagagcaagctcacgtacgcccaggcccggaagctgctgggcctcgaggacaccgcgttcttcaaggggctgcggtacggcaaggacaacgccgaggcctccaccctgatggagatgaaggcctaccacgccatcagccgcgcgctcgagaaggagggcctgaaggacaagaagtccccgctgaacctgagccccgagctccaggacgagatcgggaccgccttctccctgttcaagacggacgaggacatcaccggccggctgaaggaccgcatccagccggagatcctcgaggccctgctgaagcacatcagcttcgacaagttcgtccagatcagcctcaaggccctgcggcgcatcgtgcccctgatggagcaggggaagcggtacgacgaggcctgcgcggagatctacggcgaccactacgggaagaagaacaccgaggagaagatctacctcccgcccatccccgccgacgagatccgcaaccccgtggtcctgcgggccctgtcccaggcccgcaaggtgatcaacggcgtggtccggcgctacggcagccccgcccgcatccacatcgagaccgcgcgggaggtggggaagtccttcaaggaccgcaaggagatcgagaagcggcaggaggagaaccgcaaggaccgggagaaggccgccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtcgagatcgaccacgcgctccccttcagccggacgtgggacgactccttcaacaacaaggtgctggtgctgggcagcgagaaccagaacaaggggaaccagaccccctacgagtacttcaacggcaaggacaactcccgcgagtggcaggagttcaaggcccgggtcgagaccagccgcttcccccggtccaagaagcagcgcatcctcctgcagaagttcgacgaggacgggttcaaggagcggaacctgaacgacacccgctacgtgaaccggttcctctgccagttcgtcgccgaccgcatgcggctgacgggcaagggcaagaagcgcgtgttcgccagcaacgggcagatcaccaacctgctccggggcttctgggggctgcgcaaggtgcgcgccgagaacgaccggcaccacgcgctggacgccgtcgtggtggcctgctccaccgtcgccatgcagcagaagatcacccgcttcgtgcggtacaaggagatgaacgccttcgacggcaagacgatcgacaaggagaccggggaggtgctccaccagaagacccacttcccgcagccctgggagttcttcgcgcaggaggtcatgatccgcgtgttcggcaagcccgacggcaagccggagttcgaggaggccgacaccctggagaagctgcggacgctcctggccgagaagctgagctcccgccccgaggccgtgcacgagtacgtcacgcccctcttcgtgagccgggcccccaaccgcaagatgtccgggcagggccacatggagaccgtcaagagcgcgaagcggctggacgagggggtgtccgtgctgcgcgtgccgctcacccagctgaagctgaaggacctcgagaagatggtcaaccgggagcgcgagcccaagctgtacgaggccctgaaggcccggctcgaggcccacaaggacgaccccgcgaaggccttcgccgagcccttctacaagtacgacaaggccggcaaccgcacccagcaggtcaaggccgtgcgggtggagcaggtccagaagaccggggtgtgggtgcgcaaccacaacggcatcgcggacaacgccaccatggtgcgggtggacgtcttcgagaagggcgacaagtactacctggtgccgatctacagctggcaggtcgccaaggggatcctgcccgaccgcgccgtggtgcagggcaaggacgaggaggactggcagctcatcgacgacagcttcaacttcaagttctccctgcaccccaacgacctggtggaggtcatcaccaagaaggcccggatgttcgggtacttcgcgagctgccaccgcggcaccgggaacatcaacatccgcatccacgacctcgaccacaagatcggcaagaacggcatcctggaggggatcggcgtgaagacggccctgtccttccagaagtaccagatcgacgagctcgggaaggagatccggccctgccgcctgaagaagcggccgcccgtgcgcaagcggcccgccgccaccaagaaggccggccaggcgaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9841 - RNA, 4419 nt, synthetic construct
  misc_feature 1..4419: note = Cas9 variant mRNA product
  source 1..4419: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccctacaccatcggcctggacatcgggaccaacagcgtgggctgggccgtgctcacggaccagtacgacctggtcaagcggaagatgaagatcgccggggactccgagaagaagcagatcaagaagaacttctggggcgtgcgcctgttcgacgagggccagaccgccgccgaccggcgcatggcgcggaccgcccgccggcgcatcgagcggcgccggaaccgcatcagctacctccaggggatcttcgccgaggagatgtccaagaccgacgccaacttcttctgccggctgagcgactccttctacgtggacaacgagaagcgcaacagccggcaccccttcttcgcgacgatcgaggaggaggtcgagtaccacaagaactaccccaccatctaccacctccgcgaggagctggtgaactccagcgagaaggccgacctgcggctggtgtacctcgccctggcccacatcatcaagtaccgcggcaacttcctgatcgagggggccctcgacacccagaacacctccgtcgacggcatctacaagcagttcatccagacgtacaaccaggtgttcgcgagcgggatcgaggacggctccctgaagaagctggaggacaacaaggacgtggccaagatcctcgtcgagaaggtgacccggaaggagaagctggagcgcatcctgaagctctacccgggcgagaagtccgccgggatgttcgcccagttcatcagcctgatcgtgggcagcaaggggaacttccagaagcccttcgacctgatcgagaagtccgacatcgagtgcgccaaggacagctacgaggaggacctcgagtccctgctggcgctcatcggcgacgagtacgccgagctgttcgtcgccgccaagaacgcctacagcgcggtggtgctgtccagcatcatcaccgtcgccgagaccgagacgaacgccaagctcagcgcctccatgatcgagcggttcgacacccacgaggaggacctgggcgagctgaaggccttcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaggagaacttcctgcgcaagcagcgcaccttcgacaacggggcgatcccccaccagctgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgacttcggcaagtccgccgtggacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcctacttcagcggccaggagaaggagcagatcttcaacgacctgttcaagcagaagcggaaggtcaagaagaaggacctcgagctgttcctgcgcaacatgtcccacgtggagagccccacgatcgaggggctggaggactccttcaacagctcctacagcacctaccacgacctcctgaaggtgggcatcaagcaggagatcctggacaaccccgtcaacaccgagatgctcgagaacatcgtgaagatcctgaccgtgttcgaggacaagcggatgatcaaggagcagctgcagcagttctccgacgtcctcgacggcgtggtgctgaagaagctggagcgccggcactacacggggtggggccgcctcagcgccaagctgctgatggggatccgggacaagcagtcccacctcaccatcctggactacctgatgaacgacgacggcctcaaccgcaacctgatgcagctgatcaacgacagcaacctctccttcaagagcatcatcgagaaggagcaggtcaccaccgccgacaaggacatccagagcatcgtggccgacctggcggggtccccggccatcaagaagggcatcctgcagagcctcaagatcgtggacgagctggtctccgtgatgggctacccgccccagacgatcgtggtcgagatggcccgggagaaccagaccaccgggaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacacgggccaggacctggacatccacaacctctccaactacgacatcgaccacatcgtgccccagagcttcatcaccgacaactccatcgacaacctggtgctgaccagctccgccgggaaccgcgagaagggcgacgacgtcccgcccctcgagatcgtgcggaagcgcaaggtgttctgggagaagctgtaccaggggaacctgatgagcaagcgcaagttcgactacctcaccaaggcggagcggggcgggctgaccgaggccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccagctctacaaggtgcgcgacgtcaacgactaccaccacgcccacgacgcctacctgaacggcgtggtggccaacacgctgctcaaggtctacccccagctggagcccgagttcgtgtacggggactaccaccagttcgactggttcaaggccaacaaggcgaccgccaagaagcagttctacaccaacatcatgctgttcttcgcccagaaggaccggatcatcgacgagaacggcgagatcctctgggacaagaagtacctggacaccgtgaagaaggtcatgtcctaccgccagatgaacatcgtgaagaagacggagatccagaagggggagttcagcaaggccaccatcaagcccaagggcaactccagcaagctgatcccccggaagaccaactgggacccgatgaagtacgggggcctcgacagccccaacatggcctacgcggtggtcatcgagtacgccaagggcaagaacaagctggtgttcgagaagaagatcatccgcgtgaccatcatggagcggaaggccttcgagaaggacgagaaggccttcctggaggagcaggggtaccgccagcccaaggtcctcgccaagctgccgaagtacacgctgtacgagtgcgaggagggccggcgccggatgctcgcgtccgccaacgaggcccagaaggggaaccagcaggtcctgcccaaccacctggtgaccctcctgcaccacgccgcgaactgcgaggtgagcgacggcaagtccctggactacatcgagagcaaccgcgagatgttcgccgagctcctggcccacgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaagttcttcgagaccacgatcgagcgcaagcggtacaacaacctcaaggagctgctgaacagcaccatcatctaccagtccatcaccggcctctacgagagccgcaagcgcctggacgacaagcggcccgccgccaccaagaaggccgggcaggcgaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9842 - RNA, 4452 nt, synthetic construct
  misc_feature 1..4452: note = Cas9 variant mRNA product
  source 1..4452: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccctacagcatcggcctggacatcgggaccaactccgtgggctgggccgtggtcaccgacgactacaaggtgcccgccaagaagatgaaggtgctcgggaacacggacaagagccacatcgagaagaacctgctgggcgccctcctgttcgactccggcaacaccgccgaggaccggcgcctgaagcggaccgcgcgccggcgctacacccggcgccggaaccgcatcctctacctgcaggagatcttcagcgaggagatggggaaggtcgacgactccttcttccaccggctggaggacagcttcctcgtgacggaggacaagcgcggcgagcggcaccccatcttcgggaacctggaggaggaggtgaagtaccacgagaacttcccgaccatctaccacctccgccagtacctggccgacaaccccgagaaggtcgacctgcggctggtgtacctcgccctggcccacatcatcaagttccgcggccacttcctgatcgaggggaagttcgacacccggaacaacgacgtgcagcgcctcttccaggagttcctggcggtctacgacaacaccttcgagaactccagcctgcaggagcagaacgtccaggtggaggagatcctcacggacaagatctccaagagcgccaagaaggaccgggtgctgaagctgttccccaacgagaagtccaacggccgcttcgccgagttcctcaagctgatcgtgggcaaccaggccgacttcaagaagcacttcgagctggaggagaaggccccgctccagttcagcaaggacacctacgaggaggagctggaggtgctgctcgcgcagatcggggacaactacgccgagctgttcctgtccgccaagaagctctacgacagcatcctgctgtccggcatcctcaccgtcaccgacgtggggacgaaggccccgctgagcgcctccatgatccagcggtacaacgagcaccagatggacctggcgcagctcaagcagttcatccgccagaagctgagcgacaagtacaacgaggtgttctccgacgtcagcaaggacggctacgccggctacatcgacgggaagaccaaccaggaggccttctacaagtacctgaagggcctcctgaacaagatcgaggggagcggctacttcctggacaagatcgagcgcgaggacttcctccggaagcagcgcaccttcgacaacgggtccatcccccaccagatccacctccaggagatgcgggccatcatccgccggcaggccgagttctaccccttcctggcggacaaccaggaccgcatcgagaagctgctgaccttccggatcccctactacgtgggcccgctggcccgcggcaagagcgacttcgcctggctgtcccgcaagagcgccgacaagatcacgccctggaacttcgacgagatcgtggacaaggagtccagcgccgaggcgttcatcaaccggatgaccaactacgacctctacctgcccaaccagaaggtcctgcccaagcactccctcctgtacgagaagttcaccgtgtacaacgagctgaccaaggtcaagtacaagacggagcaggggaagaccgccttcttcgacgccaacatgaagcaggagatcttcgacggcgtgttcaaggtgtaccggaaggtcaccaaggacaagctcatggacttcctggagaaggagttcgacgagttccgcatcgtggacctgaccgggctcgacaaggagaacaaggtgttcaacgccagctacggcacgtaccacgacctgtgcaagatcctggacaaggacttcctcgacaactccaagaacgagaagatcctggaggacatcgtcctgaccctcaccctgttcgaggaccgggagatgatccgcaagcggctggagaactacagcgacctcctgaccaaggagcaggtcaagaagctggagcgccggcactacacggggtggggccgcctctccgcggagctgatccacggcatccggaacaaggagagccgcaagaccatcctggactacctcatcgacgacgggaactccaaccgcaacttcatgcagctgatcaacgacgacgccctgagcttcaaggaggagatcgccaaggcccaggtgatcggcgagaccgacaacctcaaccaggtggtgtccgacatcgccgggagcccggcgatcaagaagggcatcctgcagtccctgaagatcgtggacgagctcgtcaagatcatggggcaccagcccgagaacatcgtggtggagatggcccgggagaaccagttcaccaaccagggccgccggaacagccagcagcgcctgaagggcctgacggactccatcaaggagttcgggagccagatcctcaaggagcaccccgtcgagaacagccagctgcagaacgaccggctgttcctctactacctgcagaacggccgcgacatgtacaccggggaggagctggacatcgactacctctcccagtacgacatcgaccacatcatcccccaggccttcatcaaggacaacagcatcgacaaccgggtgctgacctccagcaaggagaaccgcggcaagtccgacgacgtgccgagcaaggacgtcgtgcggaagatgaagtcctactggagcaagctgctctccgccaagctgatcacccagcgcaagttcgacaacctgacgaaggccgagcggggcgggctcaccgacgacgacaaggcgggcttcatcaagcgccagctggtggagacccggcagatcaccaagcacgtcgcccgcatcctggacgagcggttcaacaccgagacggacgagaacaacaagaagatccgccaggtgaagatcgtgaccctcaagagcaacctggtctccaacttccggaaggagttcgagctgtacaaggtgcgcgagatcaacgactaccaccacgcccacgacgcctacctcaacgccgtgatcgggaaggcgctgctgggcgtctacccccagctcgagcccgagttcgtgtacggggactacccccacttccacggccacaaggagaacaaggccaccgccaagaagttcttctacagcaacatcatgaacttcttcaagaaggacgacgtgcggaccgacaagaacggcgagatcatctggaagaaggacgagcacatctccaacatcaagaaggtcctgagctacccccaggtgaacatcgtgaagaaggtcgaggagcagaccgggggcttctccaaggagagcatcctgcccaaggggaactccgacaagctcatcccccgcaagacgaagaagttctactgggacaccaagaagtacggcgggttcgacagccccatcgtggcctacagcatcctggtgatcgcggacatcgagaagggcaagtccaagaagctgaagaccgtcaaggccctcgtgggcgtgacgatcatggagaagatgaccttcgagcgggacccggtcgccttcctggagcgcaaggggtaccgcaacgtgcaggaggagaacatcatcaagctgcccaagtacagcctcttcaagctggagaacggccggaagcgcctgctcgcctccgcccgggagctgcagaaggggaacgagatcgtgctgcccaaccacctcggcaccctgctgtaccacgcgaagaacatccacaaggtcgacgagccgaagcacctcgactacgtggacaagcacaaggacgagttcaaggagctgctggacgtggtcagcaacttctccaagaagtacaccctcgccgaggggaacctggagaagatcaaggagctgtacgcccagaacaacggcgaggacctcaaggagctggccagctccttcatcaacctgctcacgttcaccgccatcggcgcgcccgccaccttcaagttcttcgacaagaacatcgaccgcaagcggtacaccagcacgaccgagatcctgaacgccaccctgatccaccagtccatcaccgggctctacgagacgcgcatcgacctgaacaagctgggcggggacaagcggcccgccgccaccaagaaggcgggccaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9843 - RNA, 3585 nt, synthetic construct
  misc_feature 1..3585: note = Cas9 variant mRNA product
  source 1..3585: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgcagaccaccaacctgagctacatcctcggcctggacctggggatcgcctccgtgggctgggccgtggtcgagatcaacgagaacgaggaccccatcgggctcatcgacgtgggcgtgcggatcttcgagcgcgccgaggtccccaagacgggcgagagcctggccctgtcccggcgcctcgcgcggagcacccgccggctgatccgccggcgcgcccaccggctgctcctggccaagcgcttcctgaagcgggaggggatcctctccaccatcgacctggagaagggcctgcccaaccaggcctgggagctccgcgtggcggggctggagcggcgcctgagcgccatcgagtggggcgccgtgctcctgcacctgatcaagcaccgggggtacctctccaagcgcaagaacgagagccagaccaacaacaaggagctgggcgccctgctctccggcgtcgcccagaaccaccagctgctgcagagcgacgactaccggacgccggcggagctcgccctgaagaagttcgccaaggaggaggggcacatccgcaaccagcggggcgcctacacccacaccttcaaccgcctggacctcctggccgagctgaacctcctgttcgcgcagcagcaccagttcgggaacccccactgcaaggagcacatccagcagtacatgaccgagctgctcatgtggcagaagcccgccctgtccggcgaggccatcctgaagatgctcggcaagtgcacgcacgagaagaacgagttcaaggccgccaagcacacctacagcgcggagcgcttcgtgtggctgaccaagctgaacaacctccggatcctggaggacggggccgagcgcgccctgaacgaggaggagcggcagctcctgatcaaccacccctacgagaagtccaagctgacctacgcccaggtgcgcaagctcctgggcctgagcgagcaggccatcttcaagcacctccggtactccaaggagaacgcggagagcgccacgttcatggagctcaaggcctggcacgccatccgcaaggcgctggagaaccaggggctgaaggacacctggcaggacctcgccaagaagccggacctgctggacgagatcggcaccgccttctccctctacaagaccgacgaggacatccagcagtacctgacgaacaaggtccccaacagcgtgatcaacgccctgctcgtgtccctgaacttcgacaagttcatcgagctgagcctcaagagcctgcggaagatcctgcccctcatggagcaggggaagcgctacgaccaggcctgccgggagatctacggccaccactacggcgaggcgaaccagaagacctcccagctgctgcccgccatcccggcccaggagatccgcaaccccgtcgtgctccggaccctgagccaggcccgcaaggtgatcaacgccatcatccggcagtacgggtcccccgcgcgcgtccacatcgagaccggccgggagctgggcaagagcttcaaggagcgccgggagatccagaagcagcaggaggacaaccgcacgaagcgggagtccgccgtgcagaagttcaaggagctgttcagcgacttctccagcgagcccaagtccaaggacatcctgaagttccgcctgtacgagcagcagcacgggaagtgcctctacagcgggaaggagatcaacatccaccgcctgaacgagaagggctacgtggagatcgaccacgccctgccgttctcccggacctgggacgacagcttcaacaacaaggtcctcgtgctggcctccgagaaccagaacaagggcaaccagaccccctacgagtggctgcaggggaagatcaacagcgagcgctggaagaacttcgtggccctcgtcctgggctcccagtgcagcgcggccaagaagcagcggctgctcacccaggtgatcgacgacaacaagttcatcgaccgcaacctgaacgacacgcggtacatcgcccgcttcctgtccaactacatccaggagaacctcctgctggtcgggaagaacaagaagaacgtgttcacccccaacggccagatcaccgccctcctgcggagccgctgggggctgatcaaggcgcgggagaacaacaaccgccaccacgccctcgacgccatcgtggtcgcctgcgccaccccctccatgcagcagaagatcacgcggttcatccgcttcaaggaggtgcacccgtacaagatcgagaaccggtacgagatggtggaccaggagagcggcgagatcatcagcccccacttccccgagccctgggcgtacttccgccaggaggtcaacatccgggtgttcgacaaccacccggacaccgtgctgaaggagatgctgcccgaccgcccccaggccaaccaccagttcgtccagcccctcttcgtgtcccgggccccgacccgcaagatgagcggccaggggcacatggagaccatcaagtccgccaagcggctggccgagggcatcagcgtgctgcgcatccccctcacgcagctgaagcccaacctgctcgagaacatggtcaacaaggagcgggagccggcgctgtacgccgggctgaaggcccgcctcgccgagttcaaccaggaccccgccaaggcgttcgccacccccttctacaagcagggcggccagcaggtcaaggccatccgcgtggagcaggtccagaagtccggggtgctggtgcgggagaacaacggcgtggccgacaacgcgagcatcgtgcgcaccgacgtgttcatcaagaacaacaagttcttcctggtccccatctacacctggcaggtcgccaaggggatcctcccgaacaaggccatcgtggcccacaagaacgaggacgagtgggaggagatggacgagggcgccaagttcaagttctccctgttccccaacgacctggtggagctcaagacgaagaaggagtacttcttcgggtactacatcggcctggaccgggcgaccggcaacatcagcctgaaggagcacgacggggagatctccaagggcaaggacggggtgtaccgcgtgggcgtcaagctcgccctgagcttcgagaagtaccaggtggacgagctggggaagaaccggcagatctgccgcccccagcagcggcagcccgtgcgcaagcggccggccgccaccaagaaggccggccaggcgaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9844 - RNA, 3663 nt, synthetic construct
  misc_feature 1..3663: note = Cas9 variant mRNA product
  source 1..3663: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggccgccttcaagcccaaccccatcaactacatcctgggcctcgacatcgggatcgccagcgtgggctgggccatggtggagatcgacgaggacgagaaccccatctgcctgatcgacctgggggtccgggtgttcgagcgcgcggaggtgccgaagaccggcgactccctcgccatggcccggcgcctggcccggagcgtccgccggctgacccgccggcgcgcgcaccggctcctgcgcgcccggcgcctgctcaagcgggagggcgtgctgcaggccgccgacttcgacgagaacgggctgatcaagtccctccccaacacgccctggcagctgcgcgccgcggccctggaccggaagctcacgcccctggagtggagcgccgtgctgctccacctgatcaagcaccgcggctacctgtcccagcggaagaacgagggggagaccgccgacaaggagctcggcgccctgctgaagggggtcgcggacaacgcccacgccctccagaccggcgacttccgcaccccggccgagctggccctgaacaagttcgagaaggagagcggccacatccggaaccagcgcggggactactcccacaccttcagccgcaaggacctccaggcggagctgatcctcctcttcgagaagcagaaggagttcggcaacccccacgtgtccgggggcctgaaggagggcatcgagaccctgctcatgacccagcggcccgccctgagcggggacgccgtgcagaagatgctgggccactgcacgttcgagcccgccgagccgaaggccgcgaagaacacctacaccgccgagcgcttcatctggctcaccaagctgaacaacctgcggatcctcgagcaggggtccgagcgccccctgacggacaccgagcgggccaccctgatggacgagccctaccgcaagagcaagctcacctacgcccaggcgcggaagctgctgggcctcgaggacacggccttcttcaaggggctgcgctacggcaaggacaacgccgaggcctccaccctgatggagatgaaggcctaccacgcgatcagccgggccctcgagaaggagggcctgaaggacaagaagtccccgctgaacctgagccccgagctccaggacgagatcgggaccgccttctccctgttcaagaccgacgaggacatcacgggccgcctgaaggaccggatccagcccgagatcctcgaggccctgctgaagcacatcagcttcgacaagttcgtccagatctccctcaaggccctgcgccggatcgtgcccctgatggagcaggggaagcgctacgacgaggcgtgcgccgagatctacggcgaccactacgggaagaagaacaccgaggagaagatctacctgcccccgatccccgccgacgagatccggaaccccgtggtcctgcgcgccctgagccaggcccggaaggtgatcaacggcgtggtccgccggtacggcagccccgcgcgcatccacatcgagaccgcccgcgaggtggggaagtccttcaaggaccggaaggagatcgagaagcgccaggaggagaaccggaaggaccgcgagaaggccgccgcgaagttccgggagtacttcccgaacttcgtgggcgagcccaagagcaaggacatcctcaagctgcgcctgtacgagcagcagcacgggaagtgcctctactccggcaaggagatcaacctggggcggctgaacgagaagggctacgtcgagatcgaccacgccctccccttcagccgcacctgggacgactccttcaacaacaaggtgctggtgctgggcagcgagaaccagaacaaggggaaccagacgccctacgagtacttcaacggcaaggacaactcccgggagtggcaggagttcaaggcccgcgtcgagaccagccggttcccgcgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaagggcaagaagcgggtgttcgccagcaacgggcagatcacgaacctgctccgcggcttctgggggctgcggaaggtgcgcgcggagaacgaccgccaccacgccctggacgccgtcgtggtggcctgctccaccgtcgccatgcagcagaagatcacccggttcgtgcgctacaaggagatgaacgcgttcgacggcaagaccatcgacaaggagacgggggaggtgctccaccagaagacccacttcccccagccctgggagttcttcgcccaggaggtcatgatccgggtgttcggcaagccggacggcaagcccgagttcgaggaggccgacacccccgagaagctgcgcaccctgctcgccgagaagctgagctcccggcccgaggccgtgcacgagtacgtcacgccgctgttcgtgagccgcgcgcccaaccggaagatgtccgggcagggccacatggagaccgtcaagagcgccaagcgcctcgacgagggggtgtccgtgctgcgggtgcccctgacccagctcaagctgaaggacctggagaagatggtcaaccgcgagcgggagcccaagctctacgaggccctgaaggcccgcctggaggcgcacaaggacgacccggccaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccacgatggtgcgcgtggacgtcttcgagaagggcgacaagtactacctcgtgcccatctacagctggcaggtcgccaaggggatcctgcccgaccgggccgtggtgcagggcaaggacgaggaggactggcagctgatcgacgactccttcaacttcaagttcagcctccacccgaacgacctggtggaggtcatcaccaagaaggcgcgcatgttcgggtacttcgccagctgccaccggggcaccgggaacatcaacatccgcatccacgacctggaccacaagatcggcaagaacggcatcctcgaggggatcggcgtgaagaccgccctgtccttccagaagtaccagatcgacgagctggggaaggagatccgcccctgccggctcaagaagcgcccgcccgtgcggaagcgccccgccgccacgaagaaggcgggccaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9845 - RNA, 3669 nt, synthetic construct
  misc_feature 1..3669: note = Cas9 variant mRNA product
  source 1..3669: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagtaccacgtgggcatcgacgtggggaccttcagcgtcggcctggccgccatcgaggtggacgacgccgggatgcccatcaagaccctgtccctggtgagccacatccacgactccggcctggaccccgacgagatcaagagcgccgtcacgcggctcgcgtccagcggcatcgcccgccggacccgccggctgtaccgccggaagcgccggcgcctgcagcagctcgacaagttcatccagcggcaggggtggcccgtgatcgagctggaggactactccgacccgctgtacccctggaaggtgcgcgccgagctcgccgcgagctacatcgccgacgagaaggagcggggcgagaagctgtccgtcgccctgcgccacatcgcccggcaccgcgggtggcggaacccctacgccaaggtgagctccctctacctgcccgacggcccgagcgacgcgttcaaggccatccgcgaggagatcaagcgggcctccgggcagcccgtgcccgagaccgccaccgtcggccagatggtgacgctgtgcgagctcggcaccctgaagctgcgcggggagggcggggtgctcagcgcccggctgcagcagtccgactacgcgcgcgagatccaggagatctgccgcatgcaggagatcggccaggagctgtaccggaagatcatcgacgtcgtgttcgccgccgagagccccaagggctccgccagctcccgcgtggggaaggacccgctccagcccggcaagaaccgggccctgaaggcgagcgacgccttccagcgctaccggatcgccgccctgatcgggaacctccgcgtccgggtggacggcgagaagcgcatcctgagcgtggaggagaagaacctggtcttcgaccacctcgtgaacctgacccccaagaaggagcccgagtgggtgaccatcgccgagatcctggggatcgaccggggccagctcatcggcacggcgaccatgaccgacgacggggagcgcgccggcgcccggccgcccacccacgacacgaaccgctccatcgtcaacagccggatcgcgcccctggtggactggtggaagaccgcctccgccctggagcagcacgccatggtcaaggccctcagcaacgccgaggtggacgacttcgactcccccgagggggcgaaggtgcaggccttcttcgccgacctggacgacgacgtccacgccaagctggacagcctccacctcccggtgggccgcgccgcgtactccgaggacaccctggtgcggctcacccgccggatgctgagcgacggggtcgacctgtacacggcccgcctccaggagttcggcatcgagccctcctggaccccgcccacgccccggatcggcgagcccgtggggaaccccgccgtggaccgcgtcctgaagaccgtgagccgctggctggagtccgccaccaagacctggggcgcccccgagcgggtgatcatcgagcacgtccgcgaggggttcgtgaccgagaagcgggcgcgcgagatggacggcgacatgcggcgccgggccgcccgcaacgccaagctgttccaggagatgcaggagaagctgaacgtgcaggggaagccgagccgggcggacctgtggcgctaccagtccgtccagcggcagaactgccagtgcgcctactgcggcagccccatcaccttctccaacagcgagatggaccacatcgtgccccgcgccggccaggggtccacgaacacccgggagaacctcgtggccgtctgccaccgctgcaaccagagcaagggcaacaccccgttcgccatctgggcgaagaacacctccatcgagggggtgagcgtgaaggaggccgtcgagcggacgcgccactgggtgaccgacaccggcatgcggagcaccgacttcaagaagttcacgaaggccgtggtcgagcgcttccagcgggccaccatggacgaggagatcgacgcccgctccatggagagcgtggcgtggatggccaacgagctgcggtcccgcgtggcccagcacttcgccagccacggcaccaccgtccgcgtgtaccgggggtccctgacggccgaggcgcgccgggccagcggcatctccgggaagctgaagttcttcgacggcgtgggcaagagccgcctcgaccggcgccaccacgccatcgacgccgcggtcatcgccttcacctccgactacgtggccgagaccctggccgtgcggagcaacctgaagcagtcccaggcccaccgccaggaggcgccccagtggcgggagttcaccgggaaggacgccgagcaccgcgccgcctggcgggtctggtgccagaagatggagaagctcagcgccctgctgaccgaggacctccgcgacgaccgggtggtggtcatgtccaacgtgcgcctgcggctgggcaacgggagcgcgcacaaggagacgatcggcaagctctccaaggtgaagctgagctcccagctgagcgtcagcgacatcgacaaggcctccagcgaggccctctggtgcgccctgacccgcgagcccgggttcgaccccaaggagggcctgccggccaaccccgagcggcacatccgcgtgaacgggacccacgtgtacgcgggcgacaacatcggcctcttccccgtctccgccgggagcatcgccctgcggggcgggtacgccgagctgggctccagcttccaccacgcccgcgtgtacaagatcacctccgggaagaagcccgcgttcgccatgctccgcgtgtacacgatcgacctgctgccgtaccggaaccaggacctcttcagcgtcgagctgaagccccagaccatgtccatgcgccaggccgagaagaagctgcgggacgccctcgcgaccggcaacgccgagtacctgggctggctggtggtggacgacgagctcgtcgtggacaccagcaagatcgccacggaccaggtgaaggccgtcgaggccgagctggggaccatccgccggtggcgcgtggacggcttcttctcccccagcaagctgcggctccgccccctgcagatgtccaaggaggggatcaagaaggagagcgcgccggagctgtccaagatcatcgaccggcccggctggctccccgccgtcaacaagctgttcagcgacgggaacgtgaccgtggtccgccgggactccctgggccgcgtgcggctcgagagcaccgcccacctccccgtgacgtggaaggtccagaagcgcccggccgccaccaagaaggcgggccaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9846 - RNA, 3369 nt, synthetic construct
  misc_feature 1..3369: note = Cas9 variant mRNA product
  source 1..3369: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcggcccggatcctggccttcgacatcggcatcagctccatcgggtgggccttcagcgagaacgacgagctcaaggactgcggcgtgcgcatcttcaccaaggtggagaaccccaagaccggggagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgacgagagcctcgccaaggcctacaagggctccctgatcagcccctacgagctgcggttccgcgccctcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggcgttctacaagcgggccctgaaggacttcagccacctcgtgggcaactgctccttcttcaccgacgagaagcgcgccccgaagaacagccccctggccttcatgttcgtcgccctgacccggatcatcaacctcctgaacaacctgaagaacaccgaggggatcctctacacgaaggacgacctgaacgcgctgctcaacgaggtgctgaagaacggcaccctgacctacaagcagaccaagaagctcctgggcctgagcgacgactacgagttcaagggggagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggccaagtacgacctcaaccagaaccagatcgacagcctgtccaagctggagttcaaggaccacctcaacatcagcttcaaggcgctgaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgcgcgatcaaggagtaccgcaaggtgctgaacgccctcctgaagaagtacggcaaggtgcacaagatcaacatcgagctggcccgggaggtcgggaagaaccactcccagcgcgccaagatcgagaaggagcagaacgagaactacaaggccaagaaggacgcggagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtgttcaccaagcagaaccaggagaagctcaaccagacccccttcgaggccttcggcaacgacagcgccaagtggcagaagatcgaggtcctggccaagaacctgcccaccaagaagcagaagcggatcctcgacaagaactacaaggacaaggagcagaagaacttcaaggaccgcaacctgaacgacacgcggtacatcgcgcgcctggtgctcaactacaccaaggactacctggacttcctgccgctctccgacgacgagaacaccaagctgaacgacacccagaaggggagcaaggtgcacgtcgaggccaagtccggcatgctgacgagcgccctccggcacacctggggcttctccgccaaggaccgcaacaaccacctccaccacgccatcgacgcggtgatcatcgcctacgccaacaacagcatcgtcaaggccttctccgacttcaagaaggagcaggagagcaacagcgcggagctgtacgccaagaagatctccgagctggactacaagaacaagcggaagttcttcgagcccttcagcgggttccgccagaaggtgctggacaagatcgacgagatcttcgtgtccaagcccgagcggaagaagcccagcggcgccctgcacgaggagaccttccgcaaggaggaggagttctaccagtcctacgggggcaaggagggggtcctcaaggccctggagctgggcaagatccggaaggtgaacggcaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttctgcttctccctctacaaggacagcctgatcctgatccagaccaaggacatgcaggagcccgagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9847 - RNA, 3780 nt, synthetic construct
  misc_feature 1..3780: note = Cas9 variant mRNA product
  source 1..3780: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcgacctggtgctcggcctggacatcgggatcggctccgtgggggtcggcatcctgaacaaggtgaccggcgagatcatccacaagaacagccggatcttccccgccgcccaggccgagaacaacctcgtgcgccggaccaaccgccaggggcggcgcctggcccggcgcaagaagcaccggcgcgtccggctgaaccgcctcttcgaggagtccggcctgatcacggacttcaccaagatcagcatcaacctgaacccctaccagctccgggtgaaggggctgaccgacgagctgtccaacgaggagctgttcatcgcgctgaagaacatggtgaagcaccgcggcatcagctacctggacgacgcctccgacgacgggaacagctccgtcggcgactacgcccagatcgtgaaggagaacagcaagcagctcgagaccaagacgcccggccagatccagctggagcggtaccagacctacgggcagctgcgcggcgacttcaccgtggagaaggacgggaagaagcaccggctcatcaacgtcttcccgacctccgcctaccgcagcgaggcgctgcggatcctgcagacgcagcaggagttcaacccccagatcaccgacgagttcatcaaccgctacctcgagatcctgaccggcaagcggaagtactaccacggccccgggaacgagaagtcccgcaccgactacggccgctaccggacgagcggggagaccctggacaacatcttcggcatcctcatcgggaagtgcaccttctaccccgacgagttccgcgccgccaaggcctcctacaccgcccaggagttcaacctgctgaacgacctcaacaacctgacggtgccgaccgagaccaagaagctgagcaaggagcagaagaaccagatcatcaactacgtgaagaacgagaaggcgatgggccccgccaagctgttcaagtacatcgccaagctcctgtcctgcgacgtcgccgacatcaagggctaccggatcgacaagagcgggaaggccgagatccacaccttcgaggcgtaccgcaagatgaagacgctcgagaccctggacatcgagcagatggaccgggagaccctggacaagctcgcctacgtgctgaccctgaacacggagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacccgcctcggcaagcagaagacgaccagctccagcaacaagaccaagtacatcgacgagaagctgctgaccgaggagatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgccgcacagcgtgttccacggccacaagcagctggccaccaagatccggctgtggcaccagcagggggagcgctgcctctacaccggcaagaccatctccatccacgacctgatcaacaacagcaaccagttcgaggtcgaccacatcctgcccctctccatcacgttcgacgacagcctggccaacaaggtgctggtgtacgcgaccgccaaccaggagaaggggcagcggaccccctaccaggccctcgactccatggacgacgcctggagcttccgcgagctgaaggccttcgtccgggagtccaagaccctgagcaacaagaagaaggagtacctcctgaccgaggaggacatctccaagttcgacgtgcgcaagaagttcatcgagcggaacctggtggacacgcgctacgcgagccgggtcgtgctcaacgccctgcaggagcacttccgcgcccacaagatcgacaccaaggtgtccgtcgtgcgcggccagttcaccagccagctgcggcgccactggggcatcgagaagacccgggacacgtaccaccaccacgccgtggacgccctcatcatcgcggccagctcccagctgaacctgtggaagaagcagaagaacaccctcgtcagctactccgaggaccagctgctggacatcgagaccggggagctcatcagcgacgacgagtacaaggagtccgtgttcaaggccccctaccagcacttcgtggacaccctcaagagcaaggagttcgaggactccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctggagaactaccccaacaagcagatcaacgagaagggcaaggaggtgccctgcaacccgttcctcaagtacaaggaggagcacgggtacatccggaagtacagcaagaagggcaacgggcccgagatcaagtccctgaagtactacgacagcaagctgggcaaccacatcgacatcacccccaaggactccaacaacaaggtggtcctccagagcgtgtccccctggcgcgccgacgtgtacttcaacaagaccaccgggaagtacgagatcctgggcctgaagtacgcggacctccagttcgagaagggcacggggacctacaagatcagccaggagaagtacaacgacatcaagaagaaggagggcgtcgacagcgactccgagttcaagttcaccctgtacaagaacgacctgctcctggtgaaggacaccgagacgaaggagcagcagctgttccggttcctcagccgcaccatgccgaagcagaagcactacgtggagctgaagccctacgacaagcagaagttcgagggcggggaggccctgatcaaggtcctcgggaacgtggccaactccggccagtgcaagaagggcctgggcaagagcaacatctccatctacaaggtgcggaccgacgtcctggggaaccagcacatcatcaagaacgagggggacaagcccaagctcgacttcaagcgccccgccgccaccaagaaggcgggccaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9848 - RNA, 4338 nt, synthetic construct
  misc_feature 1..4338: note = Cpf1 variant mRNA product
  source 1..4338: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgacccagttcgagggcttcaccaacctgtaccaggtgagcaagacgctccggttcgagctgatcccccaggggaagaccctgaagcacatccaggagcagggcttcatcgaggaggacaaggcccgcaacgaccactacaaggagctcaagcccatcatcgaccggatctacaagacctacgccgaccagtgcctgcagctggtgcagctcgactgggagaacctgtccgccgccatcgacagctaccgcaaggagaagaccgaggagacgcggaacgcgctgatcgaggagcaggccacctaccgcaacgccatccacgactacttcatcgggcggaccgacaacctcaccgacgccatcaacaagcgccacgcggagatctacaagggcctgttcaaggccgagctgttcaacggcaaggtcctcaagcagctggggacggtgaccaccaccgagcacgagaacgccctgctccggtccttcgacaagttcacgacctacttcagcggcttctacgagaaccgcaagaacgtgttctccgccgaggacatcagcaccgccatcccccaccggatcgtccaggacaacttcccgaagttcaaggagaactgccacatcttcacccgcctgatcacggcggtgccctccctgcgggagcacttcgagaacgtgaagaaggccatcgggatcttcgtcagcacctccatcgaggaggtgttcagcttccccttctacaaccagctcctgacccagacccagatcgacctgtacaaccagctcctgggcgggatctcccgcgaggccggcacggagaagatcaagggcctgaacgaggtgctcaacctggccatccagaagaacgacgagaccgcccacatcatcgcgagcctgccccaccggttcatccccctcttcaagcagatcctgtccgaccgcaacaccctgagcttcatcctcgaggagttcaagtccgacgaggaggtcatccagagcttctgcaagtacaagaccctgctgcggaacgagaacgtgctcgagacggccgaggccctgttcaacgagctgaactccatcgacctcacccacatcttcatcagccacaagaagctggagaccatctccagcgccctgtgcgaccactgggacaccctccgcaacgccctgtacgagcggcgcatcagcgagctgacggggaagatcaccaagtccgcgaaggagaaggtgcagcggagcctcaagcacgaggacatcaacctgcaggagatcatctccgccgccggcaaggagctgagcgaggccttcaagcagaagacctccgagatcctcagccacgcccacgcggccctggaccagccgctgcccaccacgctcaagaagcaggaggagaaggagatcctgaagtcccagctggacagcctgctcgggctgtaccacctcctcgactggttcgccgtcgacgagtccaacgaggtggaccccgagttcagcgcccgcctgaccggcatcaagctggagatggagccgtccctcagcttctacaacaaggcgcgcaactacgccaccaagaagccctactccgtggagaagttcaagctgaacttccagatgcccaccctggccagcggctgggacgtcaacaaggagaagaacaacggggccatcctcttcgtgaagaacggcctgtactacctggggatcatgcccaagcagaagggccggtacaaggccctctccttcgagccgacggagaagaccagcgaggggttcgacaagatgtactacgactacttccccgacgcggccaagatgatccccaagtgctccacccagctgaaggccgtgaccgcccacttccagacccacacgacccccatcctgctcagcaacaacttcatcgagccgctggagatcaccaaggagatctacgacctgaacaaccccgagaaggagcccaagaagttccagaccgcctacgcgaagaagacgggcgaccagaagggctaccgcgaggccctctgcaagtggatcgacttcacccgggacttcctgtccaagtacaccaagaccacgagcatcgacctgagctccctccgccccagctcccagtacaaggacctgggggagtactacgccgagctgaacccgctcctgtaccacatcagcttccagcggatcgccgagaaggagatcatggacgccgtcgagaccggcaagctgtacctcttccagatctacaacaaggacttcgcgaaggggcaccacggcaagcccaacctgcacaccctgtactggaccggcctcttctcccccgagaacctggccaagacgagcatcaagctgaacgggcaggccgagctgttctaccgccccaagtcccggatgaagcgcatggcccaccggctgggcgagaagatgctgaacaagaagctcaaggaccagaagaccccgatccccgacaccctgtaccaggagctgtacgactacgtgaaccaccgcctcagccacgacctgtccgacgaggcgcgggccctgctccccaacgtgatcaccaaggaggtcagccacgagatcatcaaggaccgccggttcacgtccgacaagttcttcttccacgtgccgatcaccctgaactaccaggccgccaacagcccctccaagttcaaccagcgcgtcaacgcctacctgaaggagcaccccgagacccccatcatcgggatcgaccggggcgagcgcaacctcatctacatcaccgtgatcgacagcacggggaagatcctggagcagcggtccctgaacaccatccagcagttcgactaccagaagaagctcgacaaccgcgagaaggagcgggtggcggcccgccaggcctggagcgtcgtgggcaccatcaaggacctgaagcaggggtacctgtcccaggtgatccacgagatcgtcgacctcatgatccactaccaggccgtggtggtcctggagaacctgaacttcggcttcaagagcaagcgcaccggcatcgccgagaaggcggtgtaccagcagttcgagaagatgctcatcgacaagctgaactgcctggtgctcaaggactacccggccgagaaggtcgggggcgtgctgaacccctaccagctgacggaccagttcaccagcttcgccaagatggggacccagtccggcttcctcttctacgtgcccgccccctacaccagcaagatcgacccgctgacgggcttcgtcgaccccttcgtgtggaagaccatcaagaaccacgagtcccggaagcacttcctggaggggttcgacttcctccactacgacgtgaagaccggcgacttcatcctgcacttcaagatgaaccgcaacctgagcttccagcgggggctccccggcttcatgcccgcctgggacatcgtcttcgagaagaacgagacccagttcgacgcgaaggggacgccgttcatcgccggcaagcgcatcgtgcccgtgatcgagaaccaccggttcaccggccgctaccgggacctgtaccccgccaacgagctgatcgccctcctggaggagaaggggatcgtcttccgcgacggctccaacatcctgcccaagctcctggagaacgacgacagccacgcgatcgacaccatggtggccctgatccggtccgtgctccagatgcgcaacagcaacgccgccaccggggaggactacatcaactccccggtccgggacctgaacggcgtgtgcttcgacagccgcttccagaaccccgagtggcccatggacgccgacgcgaacggggcctaccacatcgccctgaagggccagctcctgctgaaccacctcaaggagtccaaggacctgaagctgcagaacggcatcagcaaccaggactggctcgcctacatccaggagctgcggaacaagcgccccgccgcgacgaagaaggccgggcaggccaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9849 - RNA, 4317 nt, synthetic construct
  misc_feature 1..4317: note = Cpf1 variant mRNA product
  source 1..4317: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9850 - RNA, 4518 nt, synthetic construct
  misc_feature 1..4518: note = Cas9 variant mRNA product
  source 1..4518: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9851 - RNA, 5301 nt, synthetic construct
  misc_feature 1..5301: note = Cas9 variant mRNA product
  source 1..5301: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9852 - RNA, 3573 nt, synthetic construct
  misc_feature 1..3573: note = Cas9 variant mRNA product
  source 1..3573: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9853 - RNA, 4641 nt, synthetic construct
  misc_feature 1..4641: note = Cas9 variant mRNA product
  source 1..4641: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9854 - RNA, 3717 nt, synthetic construct
  misc_feature 1..3717: note = Cas9 variant mRNA product
  source 1..3717: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9855 - RNA, 4578 nt, synthetic construct
  misc_feature 1..4578: note = Cas9 variant mRNA product
  source 1..4578: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9856 - RNA, 3660 nt, synthetic construct
  misc_feature 1..3660: note = Cas9 variant mRNA product
  source 1..3660: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9857 - RNA, 4416 nt, synthetic construct
  misc_feature 1..4416: note = Cas9 variant mRNA product
  source 1..4416: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 9858 - RNA, 4449 nt, synthetic construct
  misc_feature 1..4449: note = Cas9 variant mRNA product
  source 1..4449: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt
